United States Patent 11,098,302 (IDENTIFICATION OF POLYNUCLEOTIDES ASSOCIATED WITH A SAMPLE) - sequence listing, part 99

SEQ ID NO: 340911 - DNA, 567 bp, Homo sapiens
  misc_feature: GZ8MTXP02FE0NF.11.59.F04.1.454.CMB.2.raw
  modified_base (172)..(172): a, c, t, g, unknown or other
  misc_feature (172)..(172): n is a, c, g, or t
  modified_base (421)..(421): a, c, t, g, unknown or other
  misc_feature (421)..(421): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtcgttataagtatgtctcatggtaccggcagaacccaggacaaacgccccccaagtcgttctctatgatgtcactaagccggccctcaggagtccctgactcgatctctggcctacctagtctcggacaaacgaccgtcctaccctagaaaccatcctcgtgggctcccgagggcctaggaggntagaggctgaatttattagttcgcttagcctatattagtagggaaactaccttacttcttttctcgtttacggaacttcggggaccaccgggttccacccgttccgtaaggtccaacgcccgaaccggacccaaaccccctactcg

SEQ ID NO: 340912 - DNA, 624 bp, Homo sapiens
  misc_feature: GZ8MTXP02G2EJL.11.59.F04.1.454.CMB.2.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtntgtctcagtggtaccgcacgaacccaggcaaaccgcccccaagtccgttctctatgatgtacactaacgccggtccctgaggactcctgactcgtattctcgtggcctacgaagtcgtaggacctaaaccgccggtcccccctcccgtagaaacctctaccgtcggttacgggcctaccgaggtctaggagttacgnggtacgtcttagtattattgtcgcgtntctatagtacgtacgtaacttaccttactttctttacgtacgttacggtacggtacggacctcggtacctaccgtacgtacgtaccaccgacccgtaaccgcccctaaccgtcttaccgtacctccgttcccgttcccgttcccctccgttccgttacgttacctcgtcctccgtacgtacgg

SEQ ID NO: 340913 - DNA, 710 bp, Homo sapiens
  misc_feature: GZ8MTXP02JHW25.11.59.F04.1.454.CMB.2.raw
  modified_base (311)..(311): a, c, t, g, unknown or other
  misc_feature (311)..(311): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtgtccgggtctccgtgggcagtcagtcaccactcccctgcacgtcggaaccagacaatgattggttggttacgttataagtatgtctcagtcggtaccgcacgaaccagaccaacgcccccaagtctctctangatgtacactacgccgcctacgaggtctccgtgtactcgacttctacgtcgccttactacgtcgtacggaccaaacccgtccggtaccccttacccgtacgtaaacccttacgttcccgtacgtcggggtcccttacccggaacggtccgtacgggaacgggtagttacgggacgttacgttaaggttaatttaacgtttagttcgtcgttagccttactaaagttacggtaacggttaaaccttaccctttaacgtttcctttttaccgtacggtttaaccggggtaaaccgttacggggtaaaccccgtacccgggttacccgtaacccggtttaccgtaacggtacccaaccggaacccccgtaaaccggtaacccctaacccccgtagttacccg

SEQ ID NO: 340914 - DNA, 546 bp, Homo sapiens
  misc_feature: GZ8MTXP02FVQ1S.11.59.F04.1.454.CMB.2.raw
  modified_base (224)..(224): a, c, t, g, unknown or other
  misc_feature (224)..(224): n is a, c, g, or t
  modified_base (378)..(378): a, c, t, g, unknown or other
  misc_feature (378)..(378): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcttataagtatgtctcatggtaccggcagaacccaggcaaacgcccccaagtcgtctctatgatgtcactaagccggccctgagatccctgactcgattctctggcctcagtctggacaacgacggcctccctgaacctntcctcgtcgggcctccgagctaggagntagagtctagtattattatgctgcctanatagtacggaacttacctactttcttttactcgttacggaaccttgggaccctacggttccaccggttaccgtaaggtccaacggccccaacggaccctaaaccccgcttccg

SEQ ID NO: 340915 - DNA, 728 bp, Homo sapiens
  misc_feature: GZ8MTXP02ISI3A.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactccctgcactggaaccagcaatgattgttggtcgttaataagtatgtactcagtcggtaccgcaacgaacccaggaccaaaccgccccccaagttccgttactctatgatcgtacactaacgccggtccctacgacggtacgtccctagacctcgtactttcgtctcggtcccttaccgtaggttcctacgggaccaaccgtacccggtccctacccgttacgaaacctacgttcccgtacgtcggggccttacccggacggtcgttacgggacggtaagttggacgggtacttaggttaatttaagttttacgttggtccgttcgtacccgttacttaagttaacggtacggttaaaccggtttaccctttaaccgttttccttttacccgtacggtttaccgggaaaccggttccgggtaacccgttacccgggtcccgttaacccgttccgtaacggttacccaaccggttacccccggaaaaccggtaccccctaaaccccgttacggttcccg

SEQ ID NO: 340916 - DNA, 624 bp, Homo sapiens
  misc_feature: GZ8MTXP02HVMHF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtcccgggtctcctgggcagtcagtcaccatcccctgcactggaaccagcaatgatgttggtcttataagtatgtctcatcggtaccgcacgaacccaggacaaacgcccccaagtcgttctctatgatgtacactaagcgcctcgagtacgtcctgactcgacttctcgtgccttacgagttctcgaccaaccgtaccggtccctacccgtagtaacctacttccgtacgtccgggactcccgaacgggtcctaggtacggagttagggacggtcttagtaattttagtttacgttggtctacgtcttacgaattagtacgtaacgttacctactttcgttttcgttaccgttacggaaccttacggggaacccttacggtccctaccgttaccgtaacggttccgaaccgtacccgaacggtaacccctacccgtacgttacccg

SEQ ID NO: 340917 - DNA, 609 bp, Homo sapiens
  misc_feature: GZ8MTXP02H4W9C.11.59.F04.1.454.CMB.2.raw
  modified_base (259)..(259): a, c, t, g, unknown or other
  misc_feature (259)..(259): n is a, c, g, or t
  modified_base (338)..(338): a, c, t, g, unknown or other
  misc_feature (338)..(338): n is a, c, g, or t
  modified_base (437)..(437): a, c, t, g, unknown or other
  misc_feature (437)..(437): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtgggcagtcagtccaccactcccctgcactggaaccagacaatgatgttgtcgttataagtatgtctnagtcggtaccgcacgaacccaggaccaaacgccccccgaagtccgttctactatgtatcgtacacgtacgccggtcctnacggcgtccctagactcgtacttcgtctcggtctacctagtcgtcggacctacgacccgtccctacctagaacctactcgtacgcgggctccgaggtcnggaagtacgtggacgtctagttattatttagtcggattcgatacgtattacgtagggtaaccttacgttacttcgttttacgaccgtttacggtaaccgtcggggtacctaccgggtcctaaccggttcgtaacggccaacggacccctaacgacccctaacccgtatcccg

SEQ ID NO: 340918 - DNA, 669 bp, Homo sapiens
  misc_feature: GZ8MTXP02HIQIL.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccggtctcctgggcagtcagtcaccactccctgcactggaaccagcaatgatgttggtcgttataagtatgtctcatcggtaccggcacgaacccaggacaaaccgcccccaagtcgttctctatgatcgtacaacgtaacgccggtcctcgaggacgtccctgactcgattcctcgtcggtcctaccgacgtcgtcggaaccaaccgtccggcccttcccgtacgaaacccttacgtcccttccgtcggggtcccttccgacgggtcctacggaggtaacgttcggaagggtccttaggttaaaatttttagttttacgttcgtacgttacgtccgttactaaagtttacggttaacggttaaccgtttaccctttacttttccgttttacgtaccggtttaccgggtaacggtaccgggtacctaccggtaccgtaccgtaccgtaacgtccgaaccgacccaaccggacccctaacccgtacgtcg

SEQ ID NO: 340919 - DNA, 488 bp, Homo sapiens
  misc_feature: GZ8MTXP02FFAGM.11.59.F04.1.454.CMB.2.raw
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (367)..(367): a, c, t, g, unknown or other
  misc_feature (367)..(367): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctggcagtcagtcaccatcccctgcactggaaccagcaatgatgttggtcgttataagtatgtctcatggtaccggcagaacccaggcaaacgccccccaagtcgttcnctatgatgtcactaagcgcctnagagtccctgactcgatctctgctcagtctgcaacacgctcctgaacntctctggctccgagctgaggatgagctgattatatgctgctcatatggaactaccttattctttactcttcggaactcgggacctacggtcaccgtctaaggcacgccagccacccgatcg

SEQ ID NO: 340920 - DNA, 515 bp, Homo sapiens
  misc_feature: GZ8MTXP02HNPWX.11.59.F04.1.454.CMB.2.raw
  modified_base (354)..(354): a, c, t, g, unknown or other
  misc_feature (354)..(354): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaaatgatgttggtcgttataagtatgtctcatggtaccggcagaacccaggcaaacgccccccaaagtcgttctctatgatgtcactaagcggccctcaggagtccctgatcgattctctggctcaagtctgcaacacggccctccctagaacatctcngggctccagctgaggatgagctgattatatgctgctcatatgaagttacctaacttcttttcttcttacggaacttgggacctacggtcaaccgtctaggtcacgcccaaggcccaacccactcgtcactctctcccaacctcctactactctctcgtctg

SEQ ID NO: 340921 - DNA, 607 bp, Homo sapiens
  misc_feature: GZ8MTXP02IWWVY.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtccaccactcccctgcactggaaccagacaatgattggttggtacgttataagtatgtctcagtcggtaccggcaacgaacccaggaccaaaccgccccctaagtccttctctatgatgtacaacgtacgccgcctacgacggtacgtccctgacctcgattcacgtgcctacagtccgtaggaccaacgccgtccctctacgactacttcgtcgtcgggctaccgagcgtaggaggtagtacggacgtacgtgtttaaattaagtttgtcgtccgttagccttagtagttagtacggtaacttaccttactttcttttacgtcgtaccggtacgtacggtacctaccgtacctccgtacgttaacggactacccgacccaaccggccccaaacccgtctccg

SEQ ID NO: 340922 - DNA, 676 bp, Homo sapiens
  misc_feature: GZ8MTXP02JQIFQ.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtcgtccgggtctccgtgggcagtcagtcaccactcccctgcactaggaaccagcaatgattgttggtcttaataagtatgtctacagtcggtaccggcaacgaaccccgaggaccaaaccgtaccccccaagttccgttctactatgatgtacacgtaacgccgtccctgacgtacgtccctgacctcgtacttctacgtcgcctacgacgtctacggaccaccgaccgtccctacctacgaacctattcctcggtcggccttacccgaggtccgtaggacggtagtagtacgggtacttaggttaatttacgtttagttcgtcgttacgacttaccgtaagttaggttacgtaaacgtttaccctttacgtttcccgttttaccgttaccggttaaccgggtaaccgtacggggtaccctaccgggtacccgtacccgttaccgaacgtaccgaacccggtacccgaaaccggtaccccaaaccccgtagttaccccgg

SEQ ID NO: 340923 - DNA, 679 bp, Homo sapiens
  misc_feature: GZ8MTXP02JB8NS.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcaagaacccaggaccaaaccgccccccaagtccgttctctatgatgtcaactacgccggccctcgaggacgtccctgactcgtacttctctcggcctccagtccgtacggccaaaccgccggtaccctcccgtagaaacctattcccgtcgtcggggacctcccggaggccttagggacgggtatacgggaggtacgtagttaaagtttatttagttcggcttacgtacctacgtaattaaggtacggtaaaccgtttaccctttacgtttccgtttttaccgtccggtttaacccgggaaccggtttacggggaacccgttaccgggttacccgtaacccggtttaccggtaacgggtccctaaaccgggacccccgaaaccgggtaccccctaaaacccgttcttaacccgg

SEQ ID NO: 340924 - DNA, 630 bp, Homo sapiens
  misc_feature: GZ8MTXP02JOUNB.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcatggtaccgcacgaacccaggacaaacgcccccctaagtccgttctctatgatgtacacgtaacgccggcctacgacggtactccctgactcgtattctcgtggcctactagtctggaccaacgaccggtccctacccgtagaaacctcttccgtcgtcgggccctccgaggtcctaggaacggtatacggagggtcttaggttaatttacgttagtcgtcgtacgtcctagtaacgttagttacggtaaaccgtttaccttactttccgtttttaccgtacgttacggaaaccgttcggggaacctaccggtacctaacccgtcgtaacggtccaaccggtaccccgaacggtacccctaaacccgtgttacccg

SEQ ID NO: 340925 - DNA, 675 bp, Homo sapiens
  misc_feature: GZ8MTXP02JTJF9.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcgagtcgtccgggtctccgtgggcagtcagtcaccactcccctgccacgtaggaaccagacaatgattggttggttacgttaataacgtatcgtctcgtagtcggtaccgacaacgaacccgaggaccaaccgcccccgtaagttcctactctagtcgatcgtactaacgtacgccggtacctacgacggtactccgtagtacctccgtacttccgtacgtcgtacctaccgtacgtcgtacggtaccaaccgtcccgtccctacccgtactaaaccgtcgttaccgtccggttacggcccttacggacgtcgtacggaaggtacgtacggtaacggtacgttacgttagtttacgttacgtcgtacgttcgtacgtacgtagtacgtacggtacttaccgttctttacgttcgtaccggttacggacgtaccggtacgtaccgtccgtacccgtacgtaaccgactacccggaccaaccgtaccccaaccgtcgtaccg

SEQ ID NO: 340926 - DNA, 554 bp, Homo sapiens
  misc_feature: GZ8MTXP02JQIG5.11.59.F04.1.454.CMB.2.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtccaccatcccctgccactggaaccagacaatgatgttggtcgttataagtatgtctcatggtaccgcagaaccccaggacaaacgccccccaagtccgttctctatgatgtcactaagcgcctnagctccctgacctcgattctctgctcagtctggcaacgcgcctccnaacatcncnggcncgagctgagatgngactgtactttagttatgcttgctacgtaattagtaggtaaccgttacttacttcgttttacgtaccgtttacggacgtcgggaaccctcgggtacccttacggttaccctaagggtccacgtacccgtaacggacccctaacccgtacgttcccg

SEQ ID NO: 340927 - DNA, 570 bp, Homo sapiens
  misc_feature: GZ8MTXP02GAOQS.11.59.F04.1.454.CMB.2.raw
  modified_base (407)..(407): a, c, t, g, unknown or other
  misc_feature (407)..(407): n is a, c, g, or t
  modified_base (507)..(507): a, c, t, g, unknown or other
  misc_feature (507)..(507): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcagtgtccgggtctccgtgggcagtcagtcaccactcccctgcactggaaccagcaatgatggttggtcgttataagtatgtctcagtggtaccggcaacgaacccaggaccaaacgcccccaagtccgttctctatgatgtacaactaacggccgccctcgaggacgtccctgactcgtattctcgtgcctacgagtcctggaccaaaccgtccgcccttcccagaaaccntctcgtcgggcctcccgagggctggaggtgtcgaaggtctagtattttattattcggactgtctacgaatagttaggaacttaccttacgtttcttttcncgttacggactgggaccacggtcaaccgtcgtaagtcacgaccaacgacccaacccgtctacg

SEQ ID NO: 340928 - DNA, 623 bp, Homo sapiens
  misc_feature: GZ8MTXP02HUSUF.11.59.F04.1.454.CMB.2.raw
  modified_base (141)..(141): a, c, t, g, unknown or other
  misc_feature (141)..(141): n is a, c, g, or t
  modified_base (220)..(220): a, c, t, g, unknown or other
  misc_feature (220)..(220): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctccgtgggcagtcagtcaccatcccctgcactggaaccagcaatgatgttggtcgttaataagtntgtctcagttcgggtaccggcaacgaacccaggaccaaaccgccccccaagtccgttctctatgatcgtacaacgtaacgccgccctagacggtacgtccctgactcgtacttctcgtggctacctaagtcgtaggaccaaaccgaccggtccccctaccgtagaactactcgtcgtcgggcctcgaggtcctagacgtatggaggtctagtatttagttattcggcttacgcctagtatacgtaggtaaacttaccttactttccttttacgtcgttacggacgtcggacctaccggtcctacgtccgtaggtaccacgacccaacggacccctaacccgactcgtacctaccttccgtaccgttcccctaacccgtctacgtactcctcgtcgtacgtcgg

SEQ ID NO: 340929 - DNA, 720 bp, Homo sapiens
  misc_feature: GZ8MTXP02GZ2W1.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgcccccgctcaggtcgtcccgggtctccgtgggcagtcagtccaccactcccctgcactggaaccagcaatgattggttggtcgttataagtatgtctcagtcggtaccggcaacgaacccgaggaccaaaccgcccccctaagtccgttctctactgatgtacacgtaacggccggtccctagacggtacgtcccgtagaccttcgtactttccgtcgtcgtaccttaccgtacgtccgtacggacctaaaccgacccggtcccttaccccgtacgaaacctacgttcccgtcggtaccgggcccgttcccgacggtccgtaggaaggtacgtagggacggtcgttaagttaacgttttaatttagttcgtcgttacgtaccttacgtaattacgggttaacggtaaacctttacccgtttacgttttccttttaccgttacccggttaaccggtaccgttaccggggtaaccccgttaccgtaccgtacccggttaccgtaacggtacctaaccggtacccgtaaccgaccccctaacccgtacgttacccg

SEQ ID NO: 340930 - DNA, 517 bp, Homo sapiens
  misc_feature: GZ8MTXP02I553V.11.59.F04.1.454.CMB.2.raw
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttgtcgttataagtatgtctcatggtaccggcagaacccaggcaaacgccccccaagtccgtctctatgatgtcactaagccgccctcaggacgtccctgactcgattctctggcctccagtctcggcacaccgctccngacntcnctggctcgagctgagntgagctgattattatgctgctcatagtgaacgttactacgttcttttctcgttacggactcggacctacgggtcctaccgtcgtaagtccacgtccccaacggtacccaacccctagttccg

SEQ ID NO: 340931 - DNA, 703 bp, Homo sapiens
  misc_feature: GZ8MTXP02HN5L5.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgcactggaaccagacaatgattgttggtacgttaataagtatgtctcagtcggtaccggcaagaacccaggaccaaaccgccccctaagtccgtctctatgatgtacacgtagccgcctgacgtactcccgtagacctcgtacttctacgtcggtacctaccgtagttccgtacggaccgtaaacccgtaccgggtcccctacccgtacgaaacctctccgttacgtcgggtaccttacccgaggtaccgtaaagggtacgttacgggacggtcttaggtaatttttaagttagtttcgccttacgtacttacgtaagttaacgtacggttaaacttaccctttacgtttccttttaccgttaccgttacggggtaaaccgtccggggtaaaccctaccggttacccgtaaccccgttaccggtacggtaacccgaacggaacccccgtaaacggaccccctaaacccctacgtttaccgtaccccg

SEQ ID NO: 340932 - DNA, 584 bp, Homo sapiens
  misc_feature: GZ8MTXP02HJM1K.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgccccccaagtcgtctctatgatgtcactaagcggccctcaggagtccctgactcgattctctggctcagtctggcaacacggcctccctgaaccatctctgggcctcccgaggcctgaggatgagtctgtattattattgctgctctatagtagggtaacttaccctactttcctttttcgtaccgtttcgggtaaaccgtttcggggaaccctaccggggttacccacccggtttaccgtaaacgggttcccaaacggtacccccgaaacgggtacccccaaaaccccggtaacttcccgg

SEQ ID NO: 340933 - DNA, 740 bp, Homo sapiens
  misc_feature: GZ8MTXP02HNH3C.11.59.F04.1.454.CMB.2.raw
  modified_base (427)..(427): a, c, t, g, unknown or other
  misc_feature (427)..(427): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcagtcgtccgggtctccgtgggcagtcagtcaccatcccctgcacgtcggaaccagcaatgatggttggtacttaataagtatgtctcagtcggtaccgcacgaaccaggaccaacgccccctaagtccgttctctatgatcgtacactacgccgtcctcgacgcgtcctagacctcgtacttcgtcgtcggtacctaccgtacgtccgtacgggacctaaaccgacccggtccctacccgtacgaaacctnttcccgtcgtcggggtaccttacccgagggtaccgtgggaacggtacgtacggggtacggttaccttaggtttaatttacgtttaagttccggtacgtttaccgaccttacgttaacgttaacggttacggttaaaacccgtttccctttaccgttttacccgttttttaccggtaacccggtttaaccggggaaccgtttacccgggggaacccgttacccgggttaccccttaaccccgggtttaccggtaaccggtaccgaaccccggaacccgtaaccccggacccccgtaaacccctccgtttacccg

SEQ ID NO: 340934 - DNA, 681 bp, Homo sapiens
  misc_feature: GZ8MTXP02IBR5W.11.59.F04.1.454.CMB.2.raw
  modified_base (254)..(254): a, c, t, g, unknown or other
  misc_feature (254)..(254): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctcctgggcagtcagtcaccatccctgcactggaaccagacaatgatgttgtacttatagtatgtntcatggtaccgcagaaccaggacaaacgccccccaagtcgttctctatgatgtacactaagccggcctcaggtactccgtgactcgtacttcgtcgtcggtcctacgtaagtccgttcggaccaaaccgtaccggcccctaccctagaaaaccctctcctcgtacgggtccacccgaggccgttacggagggtacttcggggaacgtacgttaggttaactttaaagtttttacgttcgtacgttacgtactaacgtaagttacgtacgggttaaaccttaccgtttaactttccgtttttacgttaccggtttaccgggtaaaccggttaccgggtaaccgtaccggttacccgtacccggttaccggtaacggttacccgaaaccggacccgtaaacccggaccccctaaaacccgtacgtaccg

SEQ ID NO: 340935 - DNA, 538 bp, Homo sapiens
  misc_feature: GZ8MTXP02GTU7J.11.59.F04.1.454.CMB.2.raw
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaaacgccccccaaagtccgttctctatgatgtacaactaaagccggcccctcaacggacgtcccctgaactcgattctctggcttccagtctggcaaacgaccgcctccctagaaacatctctgggctccaggctgaggatgaggntagtattattatgntnctnatatagtaatactacttctttcttcgtacgtacgtacggaccgacgtacgtaccgtacgtaacgtacgacgaccgaaccgacccaaccctacctcg

SEQ ID NO: 340936 - DNA, 648 bp, Homo sapiens
  misc_feature: GZ8MTXP02FRDUW.11.59.F04.1.454.CMB.2.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctccgtgggcagtcagtcacnctcctgcacgacgaacnacatgtatgttgtacttaataagtatgtctnagtcggtaccganaacgaaccgaggaaccaaacccgccccctaagttccgttctactagtagtagtcgtaccaacgtaaccggcccgtaccctacggacggtacctaccgtagtacctacgtacttcgtcgtacggtacctacgtacgtcgtacggaccaaccgtccggtcccctccggcgtacctactaccggtacggtcggtcctacgtacgtcgtagtagtgagtcggaggtctagttactttagtacgtgtagacgtagatagggtaggtactaacgacccgtaccgtaagtacggttccggtttcgttggttcggtttcgggtttacgggacggggtaacggaacgtacggtacgtaccggtacccgtacggtacggtaccgaacccgg

SEQ ID NO: 340937 - DNA, 517 bp, Homo sapiens
  misc_feature: GZ8MTXP02HGLDP.11.59.F04.1.454.CMB.2.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (368)..(369): a, c, t, g, unknown or other
  misc_feature (368)..(369): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccngcaatgatgttggtcgttataagtntgtctcatggtaccgnagaacccaggcaaacgcccccaagtcgttctctatgatgtcactaagcggcctcgaggacgtccctgatcgattctctggctccaagtctggcaacacgcccctcctagaacatctctgggctccgagctgagnngaggctgtattattatgctagcctatatagtagtaacttaccttactttcttttctcgttacggactcggacctcggtcaccgtctaggtcacgtcccaaagcccaaacccngtncactctcgtccncctctcgtacnctctcgctcg

SEQ ID NO: 340938 - DNA, 756 bp, Homo sapiens
  misc_feature: GZ8MTXP02F90Z3.11.59.F04.1.454.CMB.2.raw
tcagcgagagataccacgaccggtgctcgatttagtacacacacttagggattggggggctttgcctgggctctgctcctcctcagcctcctcactcagggcacaggatcctgggctcagtctgccctgactcacgccccgctcagtcgtccgggtctcctgggcagtcagtcaccatccctgcactggaaccagcaatgattgttggtcttaataagtatgtctcagtcggtaccgcaacgaacccaggaccaaacgccccctaagtcttctctatgatcgtacaacgtaacggccggtccctagacggacgtcctagactcgtacttctcgtcggacctaccgaagttccgtacggaccaaaccgtccggtccccctacccgtacgaaacctacgttccgtaccgtcgggtcctaccgaggtccgtaggagtaagtcgggaacgtcttaggttaactttagttacgttcgtacgttcgtaccttacgtaagttaacggtacggtaaacctttaaccctttaccgtttaccgtttttccggttaaccggtttaccgggtaaaccggttaccggggaaccccgttaccgggttacccgtaacccggttaccgttacggtaccgtaaaccggaccccgtaaaccggaacccctaaacccctacggttaccgtacctaacccgtttcccgttaccccgtttaccccctaaccccgtttccgtaccgtttaccttccgttaccgtccgtacggtacggg

SEQ ID NO: 340939 - DNA, 582 bp, Homo sapiens
  misc_feature: GZ8MTXP02JWXBW.11.59.F04.1.454.CMB.2.raw
  modified_base (394)..(394): a, c, t, g, unknown or other
  misc_feature (394)..(394): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtcaccactcccctgccactggaaccagcaatgatgttggtcttataagtatgtctcatggtaccgcacgaacccaggaccaaacgccccccaagtcgttctctatgatgtcactaagccggcctcgaggacgtccctgactcgattctcgtggcctcacgtctggccaaacgccggcctacctagaaacctntcctcgtcggctccgaggcctggacggatgacggctggtaatttattagttcgcttgccttagtatagtacggtaacttaccttacttcttttcctcgtttaccggaaacgttcggggacctacgggtcctaacccggttcgtaacgggtccaacgaccccgaacgggaccccaacccgacgttaccg

SEQ ID NO: 340940 - DNA, 646 bp, Homo sapiens
  misc_feature: GZ8MTXP02HQY32.11.59.F04.1.454.CMB.2.raw
  modified_base (229)..(229): a, c, t, g, unknown or other
  misc_feature (229)..(229): n is a, c, g, or t
  modified_base (460)..(460): a, c, t, g, unknown or other
  misc_feature (460)..(460): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtcccgggtctccgtgggcagtcagtcaccactcccctgcactggaaccngacaatgattggttggtacgttaataagtatgtctctagtcggtaccggcaacgaacccaggaccaaaccgaccccccgtaagtccgttctactatgactcgtactaactacgccggtaccctagacggtcgtcctagacctcgtacttctctggtcctacgagtcgtacggcaaccgccgtccctcctagaactctcgtcgtacgggccttacccgagtccgtgaacggngtagacggtacttagtaattttagtttagtcgtcgttgtccttagtaattacggtacgttaaacttaccctttacgtttacctttcgttaccgtttacggaaccgtttcgggtaccctaaccgggtctacccgttacgtaacggtccaaccgtaccccggaacgacccctaaacccgtacttcccg

SEQ ID NO: 340941 - DNA, 636 bp, Homo sapiens
  misc_feature: GZ8MTXP02H43JT.11.59.F04.1.454.CMB.2.raw
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccatcccctgcactggaaccagacaatgattgttggtacgttaataagtatgtctcatggtaccgcacgaaccgaggacaacgccccctaagtcgtctctatgtatgtacaacgtacgccgtcctgacggacgtccgtgaccgtcgtacttactcgtcggtcctaccgtacgtcgtacgacctaacgacccgtcctacccgtagaacctacgtccgtcgtacgggccctccgacgggtcctaggtaacggtatggaacggtcttagttaagtttaaagtttgttagccgttgactactaagttacgtacgggtaacttaccttactttccttttacgtacgttacggtaacgtacgggaacctaccggtaccgtacccgtacgtaacggtaccaacggaccccaaggacccccgtaaaccctactccg

SEQ ID NO: 340942 - DNA, 620 bp, Homo sapiens
  misc_feature: GZ8MTXP02FFJ5X.11.59.F04.1.454.CMB.2.raw
  modified_base (172)..(172): a, c, t, g, unknown or other
  misc_feature (172)..(172): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtctcctgggcagtcagtcaccatcccctgacactggaaccagcaatgatggttggtcgttatagtatgtctcatggtaccggcaacgaacccaggacaaacgcccccaagttcgtctctatgatgtcactaagccgcctcaggctccctgactcgactctctggcctactagtccgtaggacaaaccgaccggccttaccccgtagaaacctagttcctcgtggggtccctaccgaggtccgtaggaagggattagggacgggtactaggttaaatttagtttaattcggtaccttgccttaacagttaagtcgggaaacttacctttactcgtttttacacggtttaccggaaacgttcggggaccctaccggggttaccaacccggtttccaaagggtccacgtaccccgaacggaccccaaacccgcttaccg

SEQ ID NO: 340943 - DNA, 726 bp, Homo sapiens
  misc_feature: GZ8MTXP02HHB5T.11.59.F04.1.454.CMB.2.raw
  modified_base (226)..(226): a, c, t, g, unknown or other
  misc_feature (226)..(226): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcagccccgctcagtcgtccgggtctccgtgggcagtcagtcaccatccctgcactggaaccngcaatgattgttggtcgttaataagtatgtctcagtcggtaccggacaacgaacccgaggaccaaccgcccccaagtcgttctctatgatgtacacgtaacgccgccgtacgacggtacgtccctgacctcgtacttcgtcgttcggcctaccgtagttcgtacggaccaaaccgtaccggtaccccttacccgtacgaaaccctacgttacccgtcggttcggggtacccttcccggaagggtcccgtaggaacgggtagttacgggaaggtcgttaaggttaatttaaactttagtttcgaccggtttcgtaccgtacgtagttaacggtaacggttaaacctttacccgtttacgtttacccgttttaccggttacggttaccgggtaaaccggttaccgggtaaccccgttacgggttacccgtaccggttaaccgtaaccggtaccgtaaacccggtacccgtaaaccggtacccctaaacccgttacgtacccg

SEQ ID NO: 340944 - DNA, 767 bp, Homo sapiens
  misc_feature: GZ8MTXP02JEXTT.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactccctgcactggaaccagcaatgatgttggtcgttataagtatgtctcagtcggtaccgcacgaacccgaggaccaaaccgccccctaagttccgttctctatcgatacgtcaactaacggccggtccctacgacggtacgtcccctagaccgtccgtattcctacgtcggtacctaccgtacgtcgtacggaccaaccgtaccggtccctacccgtagaaacctacttccgtcgtcgggtacccttcccggacggtccgttacgggacggtacgtacgggtacggtaccgttaggtttaaatttaacgttttacgttccggtaccttaccggtacttaccgttaagttaacggttaacggggttaaacccgtttacccgtttacccttttcgtttttaccccggttacccggtttaaaccgggggtaacccggtttaaccggggtaaccccgtttaacccgggttaccccgttaacccggtttaccggttaacgggtaccctaaacccggttaccccgaaacccggtaccccctaaacccccgttacgtttccccg

SEQ ID NO: 340945 - DNA, 702 bp, Homo sapiens
  misc_feature: GZ8MTXP02FTI51.11.59.F04.1.454.CMB.2.raw
  modified_base (216)..(216): a, c, t, g, unknown or other
  misc_feature (216)..(216): n is a, c, g, or t
  modified_base (269)..(269): a, c, t, g, unknown or other
  misc_feature (269)..(269): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtccactactccctnacacgtacggaaccagactaagtgtagttggttcggttacttaagtaaagttntcgtctacgtaggtacggtaccgacgaaccgaacccgaggaaccaaccccgtacccccgtaagtttccttacctactagtagtactacgtacctaacgtaccggcccgtccctacggacgtacgtcctagtacctcgtactctcgtcgtcctacgtagtcgtcgacctaaccgccgttcctccgcgtactcgtacgtacgggcgtaccctcgtagtctagagtagtagcggtaacggttctaggtttaacttagttcgtacggttacgaccgtagacgtagggttaacggcttaaccgaaccccgttacgtaagttaccggtttcggttaccgtttaggggttcgggtttttaccgggggtaccggacgggggttaaacaaaccgtcggtaccgttaccgggtaccgttacggaacggtcccgaaaacccggg

SEQ ID NO: 340946 - DNA, 595 bp, Homo sapiens
  misc_feature: GZ8MTXP02I8N3O.11.59.F04.1.454.CMB.2.raw
  modified_base (268)..(268): a, c, t, g, unknown or other
  misc_feature (268)..(268): n is a, c, g, or t
  modified_base (337)..(337): a, c, t, g, unknown or other
  misc_feature (337)..(337): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccatcccctgcactggaaccagcaatgatgttggtacttataagtatgtctcagtggtaccgnaacgaaccaggaccaaacgcccccaagtccgtctctatgatgtacaactagccggcctgacggcgtccngactcgattctcgtcgcttacagtctacggaccaacgccggtccctacccgtagaaacctacgttcctacgtcggggccttcccgaggtccgtaggacggaagtcggacggtctaggtatttagttattcgtcgtcgtctataattagtacgtaacgttaacctacttcttttactcgttacggacgttcggaaccgtaccgtcctaaccggtcgttaacggcctacggacccaacggtaccccaacccgtcttaccg

SEQ ID NO: 340947 - DNA, 720 bp, Homo sapiens
  misc_feature: GZ8MTXP02G7ABD.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtcaccatcccctgcactggaaccagcaatgattggttggtcgttaataagtatgtctcagtcggtaccgcaacgaacccaggacaaacgcccccaagtccgttctctatgatcgtacactaagccggccctcgacggtacgtccctagacctcgtactttctcgtcggtcctaccgtacgttcgtacggaccaaccgtacccgggtccctacccgtaggaaacctacgttccgtacgtcggggtaccttacccggaggtccgttagggaacggtacgtagggtaacggtccgttaggttaaacttttagtttacgttcgtcgttacgtacttacgtaagttaaggtacggttaaacgtttaccctttactttccgtttttaccgttaccggtttaaccgggtaaaccggtttaccggggaaaccccgttaccgggttacccgtaacccggttacgtaaccgggttaccgaaccggtaccccgtaaacgggtccccttacccggtacccccgtttaccgg

SEQ ID NO: 340948 - DNA, 620 bp, Homo sapiens
  misc_feature: GZ8MTXP02I1XQ9.11.59.F04.1.454.CMB.2.raw
  modified_base (225)..(225): a, c, t, g, unknown or other
  misc_feature (225)..(225): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactccctgcactggaaccngcaatgattgttggtacgttataagtatgtctcagtcggtaccgcaacgaacccgacggaccaaaccgcccccaagttccgtctctatgatcgtacacgtaacgccgccctgacggtactcccgtgacctcgtacttctacgtcggaccttcgagtccgtacggaccaaccgtaccggtccctaccctagaaacctcttccgtcgtcgggtcctaccgaggtcgtaggaggtactgggaacgtcttaggttaactttagtttagttcgtcttagacctgtaataggtacgtaacgttaccttactttctttcgtacgttacggtaacgtcgggtaacctacggtacctaccgtacgtaacgtcgaacgtacccgaacgtccccaacctacgtacc

SEQ ID NO: 340949 - DNA, 707 bp, Homo sapiens
  misc_feature: GZ8MTXP02HSELN.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtccaccatcccctgcactggaaccagcaatgatgttggtcgttataagtatgtctcagtcggtaccgcaacgaacccaggaccaaaccgcccccgtaagttccgttactctatgaactcgtacaacgtacgcccggtaccctacgacggtaccgtcccgtagtaccttcgactttccgtcgttacggtcccttacgtacggttccgtacgggaccaacccgtaccggtccctaccctacgaaaccttctcccgtcgtcggggtccctacccgtacgggtccgtaggacggtacgtcgggtaacggtccttagttaactttagttttacgtcggtcttacgtacttacgtaagttacggtaacggttaaaccttaccctttacgtttcctttttcgtaccgttacgggtaaaaccgttcggggtaccctaccgggtccctaacccggttcgtaaccggtaccaacccgtaccccgtaaaaccggcccccctaaaaccgtcttaccg

SEQ ID NO: 340950 - DNA, 708 bp, Homo sapiens
  misc_feature: GZ8MTXP02FYWOW.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactcccctgcactggaaccagcaatgatgttggtcgttataagtatgtctcagtggtaccgcaacgaacccgaggaccaaaccgcccccaagttcgtctactatgtatcgtacaactaacgccggccctacgacgggtactcctgactcgtattctcgtcggccttacagtctacggacaaccgaccggtccctaccgtacgaaacctacttccgtcgtacggggtcccttcgacggcgtagggaacggtagttaggacgggtacttagttaagtttaactttagtcgtcgttcaccgttatacgttaacgttacggtaaaccgtttacctttacttttccgtttttaccttaccggttaacggggttaaaccgttccggggtaaacccgtacccgggtttaacccgttaacccccggtttccggtaaacggggttacccctaaccgggaccccccgttaaaaccggggaaccccctaaaacccccggttcgtttaacccgg

SEQ ID NO: 340951 - DNA, 649 bp, Homo sapiens
  misc_feature: GZ8MTXP02GWDCS.11.59.F04.1.454.CMB.2.raw
  modified_base (175)..(175): a, c, t, g, unknown or other
  misc_feature (175)..(175): n is a, c, g, or t
tcagcgagagataccacgaccggtgctcgatttagtacacacacttagggggctgggggtctcaggaggcagcactctcgggacgtctccaccatggcctgggctctgctcctcctcagcctcctcactcagggcacaggatcctgggctcagtctgccctgactcacgccccgntcagtgtccgggtctccgtgggcagtcagtcaccatcccctgcactggaaccagcaatgatgttggtcttataagtatgtctcagtcggtacgcacgaacccaggaccaaaccgcccccaagttcgtctactatgatcgtactactaagccgccctcgaggtacgtccctgactcgtattcgtctcggtacctcgtagtcctacggaccaaaccgccggtccctacctagaaacctcgttcctcgtcgggtcctcccgaggtccgtggaacggtagtcggacggtactggttaaatttatttagttcggtacttgaccttactaagttagtaacggtaaacttccttaacgtttccttttcgtaccgtttacggaaccgttcgggtaacccgtacgggttaccctaacccggttccgtaaacggtccgaaccggtaccccgaaaaccgggaccccctaaaaccctacggttacc

SEQ ID NO: 340952 - DNA, 614 bp, Homo sapiens
  misc_feature: GZ8MTXP02JA9B4.11.59.F04.1.454.CMB.2.raw
  modified_base (251)..(251): a, c, t, g, unknown or other
  misc_feature (251)..(251): n is a, c, g, or t
  modified_base (408)..(408): a, c, t, g, unknown or other
  misc_feature (408)..(408): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctggcagtcagtcaccatccctgcactgaaccagcaatgatgttgtcttatagtatgtctnatcggtaccgcacgaaccacggacaaaccgcccccaagttccgtctctatgatgtacactacggccgcctacgaggcgtacctgactccgtactttctcgtcggtaccttacgagtcgtacggaccaaccgcccgtcctacccgtaggtaaaccctnttcccgtccggttacggggtcccttaccggaacggtccgttagggacggtagttaccggaggttcctaaggtttaatttacgtttagtcgtcgttacgtccgtactagtacgtacgtaacgtacttcttctttactcgtacgtacgtcggtacctcgtaccacgttccgtaaggtccaacgacccgtaacgaccccaacctctacg

SEQ ID NO: 340953 - DNA, 617 bp, Homo sapiens
  misc_feature: GZ8MTXP02G36A9.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccccctgcactggaaccagcaatgatgttggtcgttataagtatgtctcatggtaccggcagaacccaggcaaacgccccccaagtcgttctctatgatgtcactaagccggccctcaggcgtccctagactcgattctctggcctacagtctaggccaaacgccggcctccctagaacatcctcgtagggcctccgaggtcctaggaacggagtacggaggtctggtaaatttattacgttggtcttaggccttagtaagttaacgtacggtaaacgttacccttaacgtttcctttttacgtcgtttaccggaacgttacgggaaccctacgggtacctaacccggttaccgtaaggttcccaaccggtaccccaaacgggtaccccctaaaccccgtcgttaacccg

SEQ ID NO: 340954 - DNA, 724 bp, Homo sapiens
  misc_feature: GZ8MTXP02I47MS.11.59.F04.1.454.CMB.2.raw
  modified_base (228)..(228): a, c, t, g, unknown or other
  misc_feature (228)..(228): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgcccctgactcagccccgctcagtgtccgggtctccgtgggcagtcagtcaccactcccctgccactggaaccngcaatgatgttggtcttataagtatgtctcatcggtaccgcacgaacccgaggaccaaccgccccccaagttccgttctctatgatgtcactaacgccggccctcgacggtacgtccctgtacctcgtattcgtactcggcctaccagttccgacggtaccaaaccgcccgggtcccttacccgtacgaaacctcttccgtcgtcggggccctacccgtaggtccgtaggaaggtacgtagggacggtaccgttagttaaacgttttacgtttagtttccgggtcttacggtacccttcgttaaagttacggttaaacggggttaaccttttaaaccccgtttcgttttaaccctttttaccgttccggtttaacccgggtaaacggttaccggggtaaaccccgttaccggttaccccgtaacccggtttaccgtaaccgggttacccgaaccggtaccccgaaccgtaacccccgtaaccctacggtttacccg

SEQ ID NO: 340955 - DNA, 671 bp, Homo sapiens
  misc_feature: GZ8MTXP02FPLZT.11.59.F04.1.454.CMB.2.raw
  modified_base (257)..(257): a, c, t, g, unknown or other
  misc_feature (257)..(257): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcaggacacaggatcctgggctcagtctgccctgactcacgccccgctcagtgtccgggtctccgtgggcagtcagtcaccactcccctgcactggaaccagcaatgatgttggtcttataagtatgtctnatggtaccgcacgaacccaggacaaaccgcccccaagttccgtctctatgatgtcactacgccgcctcgaggactcctgactcgtatctcgtcggcttaccagtcgtacggactaaccgaccggtccctcccgtagaaacctactccgtcgtgggtccctaccgaggccttaggacgggtatagggacgtcgtaggtaaatttagtttagttgaccgttgacttacgtagttaaggttacggtaaacctttaaccctttaccttttccgtttttaacctaccggtttaccgggtaaaaccgttccgggggaaaccccttaccggggttacccctacccgggtttaacctaaacggggttccaaccgggtacccccgtaaaaaccgggccccctaaaacccccgtagtttacccg

SEQ ID NO: 340956 - DNA, 677 bp, Homo sapiens
  misc_feature: GZ8MTXP02IRHH3.11.59.F04.1.454.CMB.2.raw
  modified_base (259)..(259): a, c, t, g, unknown or other
  misc_feature (259)..(259): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactcccctgccactggaaccagcaatgatgttgtcgttataagtatgtctnagtcggtaccgcacgaacccaggaccaaacgccccctaagtccgttctactagtgaactgtacactaacggccgccctacgacggtccgtccgtgtaccgtcgtatttcctacgtcggtaccctcgtacgttcgtacggaccaaacccgccggtaccctacccgtagaaacctctccgtcgtcggcctaccgaggcctggacgtagtgaggtcttaggttattagtttagtcgtacgttcgcttacgtaagttaacgtacgggttaacttacccgtttacctttcctttttaccgtacccgttaacgggtaaccgtcggggtaaaccccttaccgggtacccttaaacccggttccgttaaacggccctaaccgggtacccctaaaccgggaaccccctaacccgtacggtttacccg

SEQ ID NO: 340957 - DNA, 688 bp, Homo sapiens
  misc_feature: GZ8MTXP02HPK0S.11.59.F04.1.454.CMB.2.raw
  modified_base (224)..(224): a, c, t, g, unknown or other
  misc_feature (224)..(224): n is a, c, g, or t
  modified_base (523)..(523): a, c, t, g, unknown or other
  misc_feature (523)..(523): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgcccgctcagtcgtccggtctccgtggcagtcagtcaccatccctgcactggaaccngcaatgatgttgtcgttataagtatgtctcagtggtaccgcagaacccaggaccaacgccccctaagtccgttctctatgatcgtacaacgtaacgccggtccctcgaacggtacgtccctgtaccgtcgtactttcgtctcggacccttcgtacgttccgtggacctaaccgtaccggtccctaccgtacgaacctactcgttccgtacggggtcccttaccggtacggccgttagggaacgggtacgtcgggtaacgggtccttaggttaacttttaagttttacgttcggtcgttntacccgtataacgttacgtacgggtaacttaaccctttcgttcctttttaccgttacggttacggtaccgtaccggggtaacctaccgggtaccctttacccggccggttaaccggtaccaaccggtaccccgaaaccggtcccctaaaccccgtcgttaacccg

SEQ ID NO: 340958 - DNA, 592 bp, Homo sapiens
  misc_feature: GZ8MTXP02FKV9D.11.59.F04.1.454.CMB.2.raw
  modified_base (173)..(173): a, c, t, g, unknown or other
  misc_feature (173)..(173): n is a, c, g, or t
  modified_base (247)..(247): a, c, t, g, unknown or other
  misc_feature (247)..(247): n is a, c, g, or t
  modified_base (478)..(478): a, c, t, g, unknown or other
  misc_feature (478)..(478): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtgtccgggtctccgtgggcagtcagtcaccactccctgcactggaaccagcaatgatgttggtacgttanaagtatgtctcatggtaccgcacgaacccaggaccaaacgccccccaagtccgttactctatgatcgtacaacgtaacgccggacctcgaggaccgtcctagactccgattcgtctcggcctacgtagtcgtacggaccaaaccgccggtaccctacccgtagaaaccattccgtcgtcgggacctaccgacggtctagacgggtatacggaggtctaggtaatttagttntcgtctagtctatagttagtacgtacttacctttcttctttcgtacgttacggacgtacggtacctaccgtcctaccgtacgtcggacaccgaccgaccgaccctaaccgcgtc

SEQ ID NO: 340959 - DNA, 774 bp, Homo sapiens
  misc_feature: GZ8MTXP02H170W.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtcccgggtctcctgggcagtcagtccaccactcccctgcacgtacggaaccagacaatgattggttggtacttataagtatgtctcagtcggtacgcaacgaaccaggaccaaccgccccctaagtccttctctatgtatcgtactacgtaacgccggtaccctagacggtaccgtcccgtagtactaccgtactttcgtaccgtcggaccttaccgtacggtcgttacggacccgtaaccgtacccggtcccctacccttaacgaacccgttagttcccgtcggtccgggacccttaccggtaacgggttccgtagggtaacgggtagtacgggtaccgggttatttaaggttaaagttttaacgtttacggtacgtccgttacggtacccttagtaaagtttacggtaacgggtaaaccttttacccctacgttttacccgtttttcggacccggtttttaaccggggaaacccgttaccgggggtaaacccttacccggggttaccttaaccccgggtaccgttaaccggtacccgaaaacccggtacccccggaaaacggtacccccaaaccgttaaaacccgttcccgg

SEQ ID NO: 340960 - DNA, 625 bp, Homo sapiens
  misc_feature: GZ8MTXP02IJR0O.11.59.F04.1.454.CMB.2.raw
  modified_base (227)..(227): a, c, t, g, unknown or other
  misc_feature (227)..(227): n is a, c, g, or t
  modified_base (427)..(427): a, c, t, g, unknown or other
  misc_feature (427)..(427): n is a, c, g, or t
  modified_base (497)..(497): a, c, t, g, unknown or other
  misc_feature (497)..(497): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtcccgggtctccgtgggcagtcagtcaccactcccctgcactggaacngcaatgattgtggttacttataagtatgtctcagtcggtaccgacacgaacccgaggaccaaaccgccccccaagtccgttctctatgatgtacacgtaacgccgtacctacgacggtacctcctagacctcgtacttctcgtcggtacctaccgtaggtctacggaccaacccgtacccggtcctaccctagaaacctntcccgttacgcgggtacctccgaggccgttaggacggtagtaggacgtcgttaggttaatttaacggttnttcgtacgttcgccttagtaacgttagtaacggtaacttaacccttgtttccttttacgtcgttaccggacgttacggacctcggtacctacgtcgtaacgtcacgacccgaacgccctaccactccg

SEQ ID NO: 340961 - DNA, 683 bp, Homo sapiens
  misc_feature: GZ8MTXP02IZGV7.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtcccgggtctccgtgggcagtcagtccaccactcccctgccacgtggaaccagcaatgattgttggtacgttaataagtatgtctcagtcggtaccgcaacgaacccgaggaccaaaccgcccccctaagttccgttctctagtcgatcgtacaacgtaacgccggtccctacgaacggtacctccccgtagacctcgacttcctcgtcggaccttacgagtccgtacggacccaaccgtccggtccctaccgtagtaaccctacttccgtcgtcgggtaccctccgagtcgtaggaggtagtagtacggacgttagttaacgtttattacgttgtaccgtagtacccttacgtaagttacgtacggttaaacctttaccttaaccttttcgttttacgtccggttaacggtaaccggtcggggtaaccctacgggttaccgtacccgttacgtaaccggaccgtaaccggaccccgaacgaccccctaaccgtcgttacccg

SEQ ID NO: 340962 - DNA, 711 bp, Homo sapiens
  misc_feature: GZ8MTXP02GKY12.11.59.F04.1.454.CMB.2.raw
  modified_base (141)..(141): a, c, t, g, unknown or other
  misc_feature (141)..(141): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatcccctgcactggaaccagcaatgatgttggtacgttataagtatgtctcagtcggtaccggcaacgaacccaggaccaaaccgccccctaagtccgttctctatgatcgtacaacgtaacgccggtccctagacggactcccgtagactacgtactttctcgtggtacctaccgtaagttctaggaccaaacgaccggtccccctaccccgtagaaacctacttccgtcgtcggggtccctaccgacggggtctagggaacgtagtcggagggtcttagtaatttattacgttgccttgtaccttagtaagttagtacgggtaaactttacccttactttccgttttcttaccgttacggtaaacggtacggaacccgtacggtaccgtaacccgttccgtagggtaccaccgaaccccgaacggtaccccctaaaccccgtacttaccgtaccttaccgttcccttaccggtttacccccctaaaccgtttccccttaacggttaccttcccggtaccttccggtaccgtcggg

SEQ ID NO: 340963 - DNA, 755 bp, Homo sapiens
  misc_feature: GZ8MTXP02JTXYE.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtttcctgggcagtcagtcaccactcccctgcactggaaccagacaatgatgttggtcgttataagtatgtctcagtcggtaccgcaacgaaccgaggaccaaaccgccccctaagtccgttctactatgatgtacacgtaacgcccggtcctacgacggtccgtcccgtgtactccgtacttccgtacgtcggtacctacctaaggttccgtacgggacctaacccgtacccgggtccccttacccgtagtaaacctcgttcccgttccggttccggggtacccctttccggtacggggtacccgtttaggggaaccgggttagtaacggggtacggttaccttaaagggtttaaacttttagtttacgttcgtaccgtttggtaccttactaaggttaacggttacggtaaaccttaacccgtttcttttccgtttaccgttcggttaaaccgggtaccgtaccggggtaaccctaccggggttaccttacccggtacccgttaggtaaccccgtaacggaccccgtaacccggtaccccctaaaccccggtcttaacccggttcccc

SEQ ID NO: 340964 - DNA, 663 bp, Homo sapiens
  misc_feature: GZ8MTXP02GNGGZ.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgatgttggtcgttaataagtatgtctcagtcggtaccggcaacgaacccaggaccaaaccgccccctaagtccgttctctatgatgtacactaacgccggccctgagcgtcctgactcgattctcgtggacctacgtagtcgtacggaccgaaaccgccggtccctacccgtacgaaactactccgtcgtacgggcctacccgaggtccgtagaggatggaggtacttaggtaatttatttacgtgtcgtcgtactacgagttaacgtacgggttaaaccttccttaactttccgtttttaccgtaccggtttaaccgggtaaccggttaccggggaacccttaccgggttacccgtacccggttaccgtaaggggttacccaaccggtaccccgaaaaccggaccccctaaaccccggtactttacccgg

SEQ ID NO: 340965 - DNA, 608 bp, Homo sapiens
  misc_feature: GZ8MTXP02J25LN.11.59.F04.1.454.CMB.2.raw
  modified_base (433)..(433): a, c, t, g, unknown or other
  misc_feature (433)..(433): n is a, c, g, or t
  modified_base (545)..(545): a, c, t, g, unknown or other
  misc_feature (545)..(545): n is a, c, g, or t
tcagcgagagataccacgaccggtgctcgatttagtacacacacttagggattgggggctttccctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcttataagtatgtctcagtcggtaccgcagaacccaggaccaaacgccccccaagttccgttctctatgatgtcacgtaagccggccctgaggactccctgactcgtattctctggcctacaagtctggaccaaccgaccggcctccccctagaactactctcgcgggcctccgaggtcctggaggactggacggtctagtaatttagttagttcggcttgccttanaagttagtacgggtacttaccttacgtttctttcacgttcggaacgtcggggtacctacggtccgtaaccgtcgtacggtccacgaccccgaacggtaccccaaaacccgtntaccgtcctaccgttcctccgttaccccctaccctccgtactctcctccgtccgctcggacgg

SEQ ID NO: 340966 - DNA, 705 bp, Homo sapiens
  misc_feature: GZ8MTXP02JYGC9.11.59.F04.1.454.CMB.2.raw
  modified_base (312)..(312): a, c, t, g, unknown or other
  misc_feature (312)..(312): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccactcccctgcactggaaccagacaatgattggttggtacgttaataagtatgtctcagtggtaccgcagaacccaggaccaaaccgcccccaagtcgttctctatnatgtcaactacgccggccctacgacgtacgtcccgtgtacctcgtattctcgtcggtacctccgtagtcgtacggaccctaacgaccggtcccttaccccgtacggaaacctgttcccgtcggtcgggggtccctcccggacgggtccgtagggtaagggtagttacgggaacggtcgttaaggttaatttaagtttaacgttcgtacgttcgtaccttacgtaaagtttaacggtaacgggttaaaccgtttacccctttaaacgtttccctttttaccggttaccgtttaaccgggtaaaccgtttaccgggaacccgttaccggtaccccgtaccgttcccggtaacgtaccgaccgacccggtaaccggaccccctaccgtaacgtccg

SEQ ID NO: 340967 - DNA, 597 bp, Homo sapiens
  misc_feature: GZ8MTXP02IMCNF.11.59.F04.1.454.CMB.2.raw
  modified_base (215)..(215): a, c, t, g, unknown or other
  misc_feature (215)..(215): n is a, c, g, or t
  modified_base (421)..(421): a, c, t, g, unknown or other
  misc_feature (421)..(421): n is a, c, g, or t
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcagtgtcccgggtctcctgggcagtcagtcaccactcccngccactggaaccagcaatgatgtgtcttataagtatgtctcagtcggtaccgacacgaacccgaggaccaaaccgcccccccaagttccttctctagtgatgtaccactaacgcggcccctacgacggacgtcctagactcgtattctctcgacctcctagtctggaccaaccgaccggtccctacccgtagaaacctagttcccncgtacgggcctccgaaggcgtagaggtactggaggtactaggtatttagttacttcggctgacctactagtagtacgtacttaccgtacttctttactcgttacggacgttcggactacggtaccaccgttccgtaagtacctacggacccaacggaccctaaacccagtttaccg

SEQ ID NO: 340968 - DNA, 608 bp, Homo sapiens
  misc_feature: GZ8MTXP02IZZUN.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagccctcctcactcagggcacaggatccgtgggctcagtctgccctgactcacgccccgctcaggttcggtccgggtctccgtgggcagtcagtcaccactcccctgccactggaaccagcaatgatggttggtacttaataagtatgtctcagtggtaccgcacgaacccaggaccaaccgcccccaagtccgttctctatgatcgtacaacgtacgcggccctgacggtacgtcccgtagactacgacttcgtacgtcggccttaccgagtccgacggtaccaaccgaccggtccctacccgtagacctactctcgtcggctcgaggctaggagtagtgcgtagtagtatttattatgtctgctatagtaagtcggtaacttacctcgtttctttaccgtctttacgggaacttaacggaccttaccggtaccgtaaccgttaccgtaacgtacaccgacccgtaaaccggccccaaacccgtcgttaccg

SEQ ID NO: 340969 - DNA, 672 bp, Homo sapiens
  misc_feature: GZ8MTXP02G4DM9.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtcaccactccctgcactggaaccagcaatgattgttggtacgttataagtatgtctcagtcggtaccgcacgaccagaccaacgcccccaagtcgtctctatgatgtacacgtaacgccgccctagacggtactccctagacctcgtattctcgtcggcctactagtctacggaccaaccgccgtccctacccgtagaaacctacttccgtcgtcgggccttaccggaggtccgtaggacggtacgtcggaacggtacgttaggttaatttacgtttagttcgtcgttagtaccttacgtaagttacggtaacgggttaaacctttacccgtttactttccgtttttaccgttaccgtttaaccggtaaaccggttccggggtaaacccttaccgggtacccgtaccgttaccgtaaccggtccaacccggtaccccgaaaccggacccctaaaaccccgtacgttccg

SEQ ID NO: 340970 - DNA, 702 bp, Homo sapiens
  misc_feature: GZ8MTXP02F6UTV.11.59.F04.1.454.CMB.2.raw
  modified_base (219)..(219): a, c, t, g, unknown or other
  misc_feature (219)..(219): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcaggcacaggatcctggctcagtctgccctgactcagccccgctcagtgtccgggtctcctggcagtcagtcacatccctgcactggaaccngcaatgatgttggtacgttataagtatgtctctatggtaccgcagaacccaggacaacgccccctaagtcgtctctatgatgtcactaagccggacctcgacgacgtccctgaacctccgtaattcgtaccgtcggaccttccgtaagggtccttacggggacctaaaacccggacccggtacccgttacccccgttacggaaaccctagttcccgttccgtacggggtacccgttacccgaacggtcccgtttggaaccgggtacttagggaacgggtccttagggtaattttaacgttttaagttcggtaaccgttcggtaaccctttacgttaagttaacggttaacggttaaccgtttaccgtttaccttttcgttttaccgttaccggtttacggtaaccggtaccggtaaccgtacccgttaccgtaccgttaccgtcggtaccgaccgtacccgacgtacccaacccgtactaccg

SEQ ID NO: 340971 - DNA, 769 bp, Homo sapiens
  misc_feature: GZ8MTXP02GIYBP.11.59.F04.1.454.CMB.2.raw
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtccgggtctccgtgggcagtcagtcaccactcccctgcactggaaccngacaatgatggttggtacgttataagtatgtctcagtcggtaccggcacgaaccaggaccaacgacccccagtcgtctctatgatntacacgtagccgcctacgaggtactcctagacctacgtacttctacgtcggtactcctaggtctacgggacctaaccgtacccggggtccctacccgtagtaaaccgtcgttcccgttaccgtcggggtccttaccccgggaagggtcccgttagggaaacgggggttaacgtacggggtacggttacgttaacggtttaaacgtttttaaacggtttcgttacggttaccgttacggttaaccgttacgttaaacggtttaacgggtaacgggttaaccgtttaacccgttttacgtttttacccgtttttacccgtttaccggtttaaccggggttaaacccggttaccggggtaaacccgttacccggtaacccgttacccggttacccggtaacggtacccgtaacccggtaccccgtaaacccggacccctaaaccccggtcgttaccg

SEQ ID NO: 340972 - DNA, 647 bp, Homo sapiens
  misc_feature: GZ8MTXP02JEXBT.11.59.F04.1.454.CMB.2.raw
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcaggtcgtcccgggtctccgtgggcagtcagtccaccactcccctgcactggaaccagcaatgatggttggtacttataagtatgtctnatggaccgnacgaccagaccaacgcccccgaagtcgtctctangatgtacactacgccgtcctacgagtacgtcctagacctcgtattcctacgtcgactacgacgtctacggacctaccgaccggtccctaccgacgtaaacctcgttcctcgtccggtactccgagtccgtaggacgtacgtgacgtcgttagtagtttacttagtcgtacgtacgtacctacgtagttaacgtacgggtaaacctttccttacgtttcctttttccgtaccggtttaaccgggtaaccggtacgggtacccgtaccggttaccggtacccgttaccgtaacgggtaccacccgggtacccctaaccggacccctaaacccgtcttccccg

SEQ ID NO: 340973 - DNA, 552 bp, Homo sapiens
  misc_feature: GZ8MTXP02I49LQ.11.59.F04.1.454.CMB.2.raw
  modified_base (223)..(223): a, c, t, g, unknown or other
  misc_feature (223)..(223): n is a, c, g, or t
  modified_base (371)..(371): a, c, t, g, unknown or other
  misc_feature (371)..(371): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatccctgcactggaaccngcaatgatgttggtcttataagtatgtctcatggtaccgcagaaccagcaaacgcccccaagtcgttctctatgatgtacactaacgccggcctacgaggactcctgactcgattctctgcctcagtctggcacgcgcctcctgaacntctctcgggcctcgagctgagatgaggtctagtaatttattatcgtctagtactactattacgtacggtaacttacctacttctttacgtcgtttaccggaacgttacgggtaccgtaccggtacctaccggttacgtaacgggtccacggacccctaacggacccctaaccctacttccg

SEQ ID NO: 340974 - DNA, 802 bp, Homo sapiens
  misc_feature: GZ8MTXP02GOFJ5.11.59.F04.1.454.CMB.2.raw
  modified_base (384)..(384): a, c, t, g, unknown or other
  misc_feature (384)..(384): n is a, c, g, or t
  modified_base (442)..(442): a, c, t, g, unknown or other
  misc_feature (442)..(442): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtccaccactcccctgcacgtaggaaccagcaatgattgttggtcgttaataagtatgtctcagtcggtaccgcaacgaacccaggaccaaaccgcccccaagttccgttactctagtgactcgtactacgtaacggccggtccctacgaggtacctccccgtagtaccctacgtactttcnccgttcggcccttacgtacgttcgcggaccaaccgccgtccctaccgtacgaaacctnttccgtacgtcgggtccctccggtacggccgttaggaacggtactacggggtacgtacgtttaagttaacgttttacgtttaacgtcggtttcgtaccggtaccttaaccgtaaaggtttaacggttaaacgggtaaacccgtttttaccccgtttaaactttttccccgtttttaacccggtttacccggtttaaaccccgggggttaaaaaccgggtttcccccgggggtaaacccgttaacccgggggttacccccttaacccccgggtttaccgggttaaccggtttaccccgaaacggttacccccccggaaaacccggtacccccgtaaacccccgttaacgttttacccccgg

SEQ ID NO: 340975 - DNA, 703 bp, Homo sapiens
  misc_feature: GZ8MTXP02JFVVS.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtcgtccggtctccgtggcagtcagtccaccactcccctgacacgtacggaaccagactaagtgtagttggttggtacgttaataagttatgtctacgtacgtcggtaccgacgaacgaacccgaggaccgaaccgaccccccgtaagttccgttctacgttatacgtactcgtactaaccgtaaccggcccggtacccgtcgaacggtaccgtccgtacgtaccttccgtacttcctcgtcgtaccttaccgtagtccgtacggaccgaaccgtaccggtccctaccgtacgtaactcgttccgtcggtcgtaccgtccggtacgtcgtacggtaggtacgtaggacgttacgttagttaaatttacgtttacgtcgtacgttctaccgtagtagttacgttacggttaacttaccgtttactttcgttttacctaccggttacgtaaaccggtcggttaaaccgtccgttaccgtccgttaccgaacggtaccaccggaccgtaccgacccctaacgtctaccg

SEQ ID NO: 340976 - DNA, 760 bp, Homo sapiens
  misc_feature: GZ8MTXP02G44WY.11.59.F04.1.454.CMB.2.raw
  modified_base (172)..(172): a, c, t, g, unknown or other
  misc_feature (172)..(172): n is a, c, g, or t
  modified_base (186)..(186): a, c, t, g, unknown or other
  misc_feature (186)..(186): n is a, c, g, or t
  modified_base (224)..(224): a, c, t, g, unknown or other
  misc_feature (224)..(224): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgntcagtgtccgggtntcctgggcagtcagtcaccatcccctgcactggaaccngcaatgatgttggtcttataagtatgtctcatcggtaccgcacgaaccaggacaaacgcccccaagtcgttctcgtatgagtgtacactaacggtccggcctcgacggacgtccctgactcgattcgtactggtacctcgtacgtctcgggacctaaacgcccggtcctacccggtagaaacctcttcccgtacgtcggggtacccttaccgaaacgggtccttaacgggaacgggtaagttcggaaaccggggtttacgtaaggttaactttaacgttagttacggtaccgttacgtacctaacgttaacgttaacggtacgggttaaaccgtttaccgtttacgttttacccggtttttacccgtaaccggggttttaaaccgggaaaccgggtttaacccggggtaaccccggttaaaccggggttacccccgtaaacccgggtttacccggtaaaccgggttaccccgaaaacccggggttacccccggtaaacccggtaacccccgaaaaccccggtttacgtttacccgg

SEQ ID NO: 340977 - DNA, 683 bp, Homo sapiens
  misc_feature: GZ8MTXP02JXPFP.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtgtccgggtctccgtgggcagtcagtcaccactcccctgcactggaaccagcaatgattgttggtacttaataagtatgtctcgagtcggtaccgcacgaacccaggaccaacgcccccaagtcttctctatgatgtcaacgtagccggcctgacgtaccgtcctagacctcgtattcgtacgtggcctaccgtagtccgtacggacctaaccgccgggtccctacccgtaggtaaacctacgtttcccgttcggggcccttaccggaggtactaggggtaaggtacgtacgggtacgtaccttagggttaatttaaagtttcgtcggtacttcggtactactaagttacggtacgggttaaaccttccctttaactttcctttaccgttacggttaaaccgggtaccgttaccggggtaccctaaccgggttccacccggtttaccgtaggtaacccaacccggtacccgaaccggtacccctaacccgtacgttacgtaccccg

SEQ ID NO: 340978 - DNA, 741 bp, Homo sapiens
  misc_feature: GZ8MTXP02JDVCI.11.59.F04.1.454.CMB.2.raw
  modified_base (142)..(142): a, c, t, g, unknown or other
  misc_feature (142)..(142): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcacgccccgntcagtgtccgggtctccgtgggcagtcagtcaccactcccctgcactggaaccagcaatgatggttggtacgttaataagtatgtctcagtcggtaccgcacgaacccaggacaaaccgcccccaagttccgttctctatgatcgtacacgtaacggccgtccctacgacggtactcccgtagacttcgtactttcctacgtcggacctaccgtaagttccgtcggaacctaaaccggtcccggtaccccccttaccccgtacgtaaaccctacgtttcccgttacggtccggggtcccttaccgacgggtacgtacgggaacggtagttcggggaacgggttacgttagttaaagttttactttaggttgtccgttacgacttacgtaagtttacgacggttaaacctttacctttaccgtttccttttaccgttacgttccgggtaaccgtcgggaacccgtacggttaccgtacccgtacgtacggtaccaccggtacccgaaaccgtaccccaaacccgttacgtccgttacctaccgttaccctcccgtttacccccaaccgttcctacgttcctccgtaccgtcgtacgtcgg

SEQ ID NO: 340979 - DNA, 652 bp, Homo sapiens
  misc_feature: GZ8MTXP02HRFAF.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctccgtgggcagtcagtccaccactcccctgccactggaaccagcaatgatgttggtcttataagtatgtctcagtcggtaccggcaacgaacccgaggaccaaaccgaccccctaagtccgttctctatgatgtacacgtaacgccggccctcgacggtacgtcctgactcgtattctcgtgtacctcgagtcgtacggaccaaccgaccggccctacctacgaaactctccgtcgtcgggcctccgtaggccgtaggacggggtatacgggaggtaccgttagttattttaacgtttgttgtcgttcggtactacgttaataggtaacggttaaccttaccctttaacgtttccctttaccgttccgttacgggtaaaccgttcgggaacccgtacgggtaccctaacccggtcgtaaccggtccaaccggtaccccaacggtacccccaacccgtacgttaccg

SEQ ID NO: 340980 - DNA, 706 bp, Homo sapiens
  misc_feature: GZ8MTXP02HGS23.11.59.F04.1.454.CMB.2.raw
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgntcagtgtccgggtctccgtgggcagtcagtccaccactcccctgcactcggaacngcaatgatgttggtacttataagtntgtctcagtcggtaccgacacggaacccaggaccaaaccggccccccaagttccgttactctatgtagtcgtacaacgtacgccggtcctcgacggtacgtcctgaccttcgtacttcgtcgtcggccttaccgtacgtcgtacggaccaaccgtacccggtccctacccggtacgtaaacctcgttccgtacgttcggggaccttacccggaggtcctagggaaggtactagggaacgggttacctaggtttaatttacgtttagttcggcggttactaccgttacaagttacggttacgggtaacctttaccttaaccgtttctttttaccgtacggtttaccggtaaacggtacgggtacccgttaccgggtacccgtacccggtttaccgtaaccgggtaccgtacccggaccccgttaaaaccggccccctaaacccgtacgttcccg

SEQ ID NO: 340981 - DNA, 694 bp, Homo sapiens
  misc_feature: GZ8MTXP02H3YBB.11.59.F04.1.454.CMB.2.raw
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagcgagagataccacgaccggtgctcgatttagtacacacacttagggggctggggtctcaggaggcagcactctcgggacgtctccaccatggcctgggctctgctcctcctcagccctcctcactcagggcacaggatcctgggctcagtctgccctgactcacgccccgctcaggtcgtccgggtctccgtgggcagtcagtccaccactcccctgcactacggaaccagacaatgattggttggtacgttataagtntgtctnagtcggtaccgacaacgaaccgaggaccaaaccggcccccgtagttccgtctactatgagtcgtactaacgtacgccggtccctacgaacggtccgtcctagtacctcgtacttcgtacgtcgaccttaccgtacgtccgtacggacccgtaaccgtacccgtaccctaccgtacgtaaaccctcgtcccgttccgtacggggtaccctacccgggtacggtcggtagggaacggtagttacggaacggtcgttaagttatttacgtttagtcggtctcgtactagtagttaacgtacggttaaccttactttcttccgttttacgtacggttacggtaccgtacgggtacccgtaccgttcctaaccgttcgtaaccgaccgaaccggtacccgaaccggtaaccccctacccgttacgtcccg

SEQ ID NO: 340982 - DNA, 744 bp, Homo sapiens
  misc_feature: GZ8MTXP02FV1YX.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtcgtccgggtctccgtgggcagtcagtcaccactcccctgcactggaaccagacaatgatggttggtacgttaataagtatgtctcagtcggtaccgcaacgaacccaggaccaaaccgccccccaagttccgttactactatgtatcgtaccaacgtaacggccgaccgtacgacggtacctcccgtagaccgtcgtacttcgtccgtacggtcctaccgtacgtccgtacggtaccaacccgtcccggtaccctacccgtacggtaaaacctcgttacccgtcggtcggggtacccttaccggaacgggtccgtaagggtacgggtagttacgggaggttaccgttaggttaactttatttacgttcggtacttgtacctacgtaagttaggttaacggttaactttaacccgtttctttaccgttttaccgttacggttaaccggtaaaccggttccggggaaacccgttaccggggttaccccacccggtttacccgaacggttaccccgaacccggtaccccggtaacccggaaaccccctaccccggttaacttacccgg

SEQ ID NO: 340983 - DNA, 749 bp, Homo sapiens
  misc_feature: GZ8MTXP02HIW5B.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctccgtgggcagtcagtccaccactccctgccactcggaaccagcaatgattggttggtacttataagtatgtctcagtcggtaccggacaacgacccgaggaccaaaccgcccccctaagtccgttactctatgatcgtacacgtaacgccgtacctacgacggtactcctgacctacgtacttcctcgtcggccttaccgtacgtcgtacggaccaaccgtacccggtccctacccgtagaaacctacgttcccgttacgtccgggtaccttaccggacggtccttaggacggtagttcggacggttacgtaggtttaagtttaacgtttacgtgtaccgttacggtaccttacgttaagttacgttaacggggttaaacctttacccgtttacttttcccgttttttaaacccggccggttttaaacccgggtaaaccggttaccgggtaaccccggttacccggttacccgtaaccccggtttaccgttaaccggttcccgaaaacccggttaccccgaaaacccggtacccccctaaaaccccgttacgtttacccg

SEQ ID NO: 340984 - DNA, 644 bp, Homo sapiens
  misc_feature: GZ8MTXP02JEBE3.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagtcgtccgggtctcctgggcagtcagtcaccatcccctgcactggaaccagcaatgatgttggtcttataagtatgtctcatcggtaccggcacgaaccaggaccaaacgcccccaagtccgttctctatgatgtacactacgccggtcctgacggactccctagactcgtacttctacgtggccttcctaggtcctacgggaccaaaccgccgggtccctacccgtagaaacctcgtcctcgtcgggcctccgaggtccgtaggacggtagtaggacgtacgttaggtaatttacgttagttcgtccgttaggtccgttactaagttacgtaggtaaaccttccttaactttccttttccgtacgttacggaaaccgttcgggaacccgtacggtacccgtaccggttacgtaacgggttaccaacggtaccccgaaacggtacccctaaaaccccgacgtttcccg

SEQ ID NO: 340985 - DNA, 576 bp, Homo sapiens
  misc_feature: GZ8MTXP02GT4KJ.11.59.F04.1.454.CMB.2.raw
  modified_base (227)..(227): a, c, t, g, unknown or other
  misc_feature (227)..(227): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcacgccccgctcagtgtccgggtctcctgggcagtcagtcaccatcccctgcactaggaaccngacaatgatgttgtcgttatagtatgtctcatggtaccgcacgaaccagacaacgcccccaagtcgtctctatgtatgtcactagccggacctgacgtgtccctgactcgatttcgcgtcggtacctctacggtctacgggccaaaccgccgccctcctagaactntaccgtcgtcgggctacgaggcgtggacgtagtgacgtcgtagtattaacttgtgtcgtctntactatagtggtaaacctacttacgtttctttcttacgtacgtaacgtcggtaccgtacgtacctaaccggttctaacgggttcaccggttaccgaaccggtacccaacccgtacgtcccg

SEQ ID NO: 340986 - DNA, 796 bp, Homo sapiens
  misc_feature: GZ8MTXP02HCAQF.11.59.F04.1.454.CMB.2.raw
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatccgtgggctcagtctgccctgactcacgccccgctcagtcgtccgggtctccgtgggcagtcagtccaccactcccctgccacgtggaaccngacaagtgnttggttgtacgttataacgtatgtctnagtcggtaccgcacgaccaggaccaaaccgcccccaagtcgttctactatcgatcgtacaacgtacgccgaccgtacgacggtaccgtaccgtacgtacctccgtacttccgtcgtcggtaccgtacctacgggttctacggaccgtaaccgacccggtacccgttacccgtaaccgtaaacctaccgttacccgttccggtaccggggtacccttaaccccgggagttcgtacgggtaacggtacggtacggtacgggtacttacggtttaactttaacggtttacgttcggttacgtacgttaccgtacgttaacgttaacggtacggttaaacccttaccgttttacccgtttccgtttttaccggttacccgttaaaccgggggttaacccgttacccggggtaaacccggttacccggggtttaacccgtaaccccggtttaccgggttaaccccggtacgtaaccccgggtacccccggtaacccgtaacccccgtaaacccccgtttaaccgtttccccgg

SEQ ID NO: 340987 - DNA, 596 bp, Homo sapiens
  misc_feature: GZ8MTXP02FTMD7.11.59.F04.1.454.CMB.2.raw
  modified_base (365)..(365): a, c, t, g, unknown or other
  misc_feature (365)..(365): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccgcagaacccaggcaaacgcccccaagtccgttctctatgatgtcactaagccggccctcaggacgtccctgactcgattctctggctccagtctggacaacncggcctccctgaacatctcgtcgggctccgagctagacggatgaggtctagatttagttattgcttgcctatagtagttgggaaacgttacctttaacttcctttttacgtccgttttacgggtaaaccgttcgggggtaaccctacggggttacccaacccggtttccgttaacgggtcccgtaacggtaccccgaaaccgggtaccccaaaacccccggtctttacccg

SEQ ID NO: 340988 - DNA, 701 bp, Homo sapiens
  misc_feature: GZ8MTXP02JAZRX.11.59.F04.1.454.CMB.2.raw
  modified_base (227)..(227): a, c, t, g, unknown or other
  misc_feature (227)..(227): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccactcccctgccactcggaaccngcaatgtattggttggtacgttatagtatgtctcatcggtaccgcacgaccagaccaacgcccccagtctctctatgatgtcactaacggccgtaccctcgagtacgtccctagactcgtacttcgtctcgccttacacgtcgtcggactaaccgccggtacccttcccgtacgaaacctacttaccgtcccggttcgggcccttacccggaggtaccttacggaaggtacgttacggacggtacgttacgtaagtttatttagttacggtaccgttcgtacctacgtaatttacggtaacgggttaaccttaacccgtttacttttacccgtttttaccggttacgttacccgggttaaaccggttacggggaaccccgttacgggttacccgtaacccggttaccgtttaacggggtaaccaacccggtacccccgtaaacgggtaccccccaaacccgtccggtttaaccc

SEQ ID NO: 340989 - DNA, 620 bp, Homo sapiens
  misc_feature: GZ8MTXP02F065Z.11.59.F04.1.454.CMB.2.raw
  modified_base (506)..(506): a, c, t, g, unknown or other
  misc_feature (506)..(506): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcaggtcgtcccgggtctccgtgggcagtcagtccaccactcccctgcacgtggaaccagcaatgatgttggtacgttataagtatgtctgagtcggtaccgcaacggaacccaggaccaaaccgaccccctaagttccgttctactatgtacgtcgtacaacgtaacgccggtccctacgacgtcgtaccgtgtaccgtacgtacttccgtacgtcggtacctaccgtacgtcgtcgacctaaccgccgtccctaccgtacgaactcgtctcggtacggtctcgagtctagacggtgtacggacgtagttatatttagtagttcaccgttanactagtagtacgtacgtaaccttcgttactttcttacgtacgtacggtacgtacggccgtaccgtacctaccggtacgtaacgaccaccggaccaccgtacccgacctcgtacg

SEQ ID NO: 340990 - DNA, 608 bp, Homo sapiens
  misc_feature: GZ8MTXP02JO4JI.11.59.F04.1.454.CMB.2.raw
  modified_base (141)..(141): a, c, t, g, unknown or other
  misc_feature (141)..(141): n is a, c, g, or t
  modified_base (218)..(218): a, c, t, g, unknown or other
  misc_feature (218)..(218): n is a, c, g, or t
  modified_base (328)..(328): a, c, t, g, unknown or other
  misc_feature (328)..(328): n is a, c, g, or t
  modified_base (568)..(568): a, c, t, g, unknown or other
  misc_feature (568)..(568): n is a, c, g, or t
tcagcgagagataccacgaccggtgctcgatttagtacacacacttagggattggggggctttgcctgggctctgctcctcctcagcctcctcactcagggcacaggatcctgggctcagtctgccctgactcagccccgntcagtgtccgggtctcctgggcagtcagtcaccatccctgcactggaaccagcaatgatgttggtacttaataagtntgtctcagtggtaccgcagaacccaggaccaaacgcccccaagtccgttctctatcgatgtacactaagccgcctgaggactcctgatcgattctctggcttccaagtcnggaccaacgaccgtcccctaccgagaaactcttccgtcgtcgggtcctcgaggtctacgaggtatggaggtctagtaactttgtattcgacttgcctataagtagtacggtaacttaccttacgtttcctttacgtcgttacggaacgtcggacctacgtaccacgtcgtaggtaccacgacccgtaaaccggcccaaacccgtcgtcgtaacccaccgttcccgttaccgttacccccnccgtttaccccgtcgttacctccgtcctccgtacgtcggg

SEQ ID NO: 340991 - DNA, 795 bp, Homo sapiens
  misc_feature: GZ8MTXP02I5JJ6.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcacgccccgctcagttggtccgggtctccgtgggcagtcagtcaccatcccctgccacgtggaaccagcaatgattgttggtcttaataagtatgtctcatggtaccggcaacgaacccgaaggaccaaaccgacccccccgtaaaggttccgttactctaagtgacgtctacgaacgttaaacggccggtcccctacgaggtaccgtccccgtagtaacctccggtatttccgtacgttcggaccttaacccgacggttcgttaccggggaacctaaaccccgtaacccgggtcccttacccccgtaaacgtaaacctacttcccgttcgtacgggggcccttacccgagggtcccgtaaggaggacgttagggacgggtacttaggttaattttacgttttagttacgcgtttaacgcctttaacgtaagttaacggtaggggtaaacccgttttaacctttaaaccgtttttcctttttaaccggttaccgtttttaccggggaaaccggttttccggggaaaccccgtttaccggggtaacccttaccccggtaccgttttaagggtaccccgtacggtaaacccccggaaccggtaaaccccctaacccccggtacgtttaacccgg

SEQ ID NO: 340992 - DNA, 556 bp, Homo sapiens
  misc_feature: GZ8MTXP02GZO6V.11.59.F04.1.454.CMB.2.raw
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (441)..(441): a, c, t, g, unknown or other
  misc_feature (441)..(441): n is a, c, g, or t
tcagcgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtccaccatcccctgcactggaaccngcaatgatgttggtcttataagtatgtctcatggtaccgnanaaccaggacaacgcccccaagtctctctatgatgtcacgtaagcggccctcgacggtacgtccctgactcgattcgtctggccttccaggttctggacctaacgcggccttcccagaactatctctgggcctcgtagcctggagactgaggtatggtatttattagtttgcgtntctactatagtagtacgtactacttactttcgttcgttacgtacgtacggtaccgtaccgtaccgtaccgtacgtaacgtacgtacgacccgaaccgaccgtaaccctacgtacg

SEQ ID NO: 340993 - DNA, 631 bp, Homo sapiens
  misc_feature: GZ8MTXP02I97JT.11.59.F04.1.454.CMB.2.raw
tcagcgagagataccacgaccggtgctcgatttagtacacacacttaggggctggggtctcaggaggcagcactctcgggacgtctccaccatggcctgggctctgctcctcctcagccctcctcactcagggcacaggatcctgggctcagtctgccctgactcacgccccgctcagtcgtccgggtctccgtgggcagtcagtcaccactcccctgcacgtaggaaccagcaatgtattggttggtacgttaataagtatgtctcagtcggtaccgcaacgaacccaggaccaaccgccccctaagtcgttctctatgatcgtacactaacgccgcctcgacgtccgtccgtgactcgtacttctcgtagcctactagtcacggacaccgccgtcctcctacgaactactaccgtcgtcggtcctcgtagtccgtaggaggtatacgacgtaccgttagttagtttaactttgtcgtcgttacgaccttagacgttacgtaacggtaactttaccttacgtttcctttaccgtacgttaacggaaccgttacgggaacccgttaccggtacgtacccgttcgtaacggtaccgaccgaccccgaacgtaccccaacccgttacgttccg

SEQ ID NO: 340994 - DNA, 657 bp, Homo sapiens
  misc_feature: GZ8MTXP02FHJ4F.11.59.F04.1.454.CMB.2.raw
  modified_base (172)..(172): a, c, t, g, unknown or other
  misc_feature (172)..(172): n is a, c, g, or t
  modified_base (358)..(358): a, c, t, g, unknown or other
  misc_feature (358)..(358): n is a, c, g, or t
  modified_base (473)..(473): a, c, t, g, unknown or other
  misc_feature (473)..(473): n is a, c, g, or t
tcagcgagagataccacgaccggtgctcgatttagtacacacacttagggtctggggtctcaggaggcagcactctcgggacgtctccaccatggcctgggctctgctcctcctcagcctcctcactcagggcacaggatcctgggctcagtctgccctgactcagccccgntcagtgtccgggtctccgtgggcagtcagtcaccactcccctgcactggaaccagcaatgatggttggtcgttataaggtatgtctcatggtaccgcacggaacccaggccaaacgccccccaagtccgttctcgtatgtactcgtcactaacgtcggccctcacggacgtcccctgacctacgtnttcgtctcggtccacgtaggtcctaggccaaacgtccgtccctcccgtagactatcccgtcgtcggctccgaggccgttggaaacggtgtagcggaccgttatagtttaagtttntcgtcgtacgtcctagtacgttacgtacggttaacgttacctttaccgtttaccgttttaccgttaccgttaccggtaccggttaccgggtaccgtacccgttaccgtaaccccgttaccggttaacggtacccgtaacccgtacccccggaaacccggtacccctaaacccgtaccgttaccg

SEQ ID NO: 340995 - DNA, 713 bp, Homo sapiens
  misc_feature: GZ8MTXP02F34I7.11.59.F04.1.454.CMB.2.raw
  modified_base (173)..(173): a, c, t, g, unknown or other
  misc_feature (173)..(173): n is a, c, g, or t
  modified_base (262)..(262): a, c, t, g, unknown or other
  misc_feature (262)..(262): n is a, c, g, or t
tcagcgagagataccacgaccggtgctcgatttagtacacacacttaggggctggggtctcaggaggcagcactctcgggactctccaccatggcctgggctctgctcctcctcagcctcctcactcagggcacaggatccgtgggctcagtctgccctgactcacgccccgntcagtcgtccggtctcgtgggcagtcagtcaccactcccctgcacgtcggaaccagactaaatcgtatggttggtacttaagtaaagtntggtactcagtcggtaccgcaacgaacccgacggaccaaaccgccccctaaggttccttacacgtatacgactgtaccaacgtaacgccgaccttacgaacggtactccctaggtacctcggtacttccgtacgttcggaccttaccgagttccgacggactaaacccgccggtaccctccgtaagaaacctcgttaccgcgtacggccgttaacccgaggtcgtaggaaacgttgaacggtgtcgttaagtatttaaactgttcggacctagtacccgtttaatacgttaaggtacgggttaacttaaacccggtttacgtttccttttacgtacccgtttacgggaaacctccgggggtaaccttaccgggtaccctacccgtacggtttaacggtcccctaaacggtaacccccggtaacgtacccccaaaaccccggtttctaaccg

SEQ ID NO: 340996 - DNA, 656 bp, Homo sapiens
  misc_feature: GZ8MTXP02IM58V.11.59.F04.1.454.CMB.2.raw
  modified_base (257)..(257): a, c, t, g, unknown or other
  misc_feature (257)..(257): n is a, c, g, or t
  modified_base (543)..(543): a, c, t, g, unknown or other
  misc_feature (543)..(543): n is a, c, g, or t
tcagcgagagataccacgaccggtgctcgatttagtacacacacttaggggctgggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccactccctgcactggaaccagcaaatgattggttggtcttaataagtatgtntcatggtaccgcaacgaaccaggcaaacgcccccaaagtccgttctactatgaactgtacaacgttaaagccggacccctgaaacgtacgtcccctagaccttcgaactttctcgtggtccttacctagtctacggaccaaaccgcccggtctaccctagaaactacgccgtcgtcgggcctcgacggtcgtacgtaggaagttgacggtacgtgttaatttaaacgtttattcggtctacgtccttacgtaatacggttaacggtaagttaaccttaaccgtttntttttaccggtccgtttaacggtaaaccggttcggggaaacccgtaacggtcctaacccgtttcccgaaggttaccaacggacccgtaaaccgccctaaaccccgtacttccg

SEQ ID NO: 340997 - DNA, 609 bp, Homo sapiens
  misc_feature: GZ8MTXP01CTKGS.9.14.B03.1.454.CMB.2.raw
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (442)..(442): a, c, t, g, unknown or other
  misc_feature (442)..(442): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgtttatggtacaanagaagtcaggccacggccccccttnagtcatctatgaggacgccaggccgaccccgtcgggatcccctgagagaatcgcggctcagttccgagggacagtcggcccaaccgttgaacgagtcggggtcggggcccagggtaggaaacgagtagaagcgtagacttacttctagttactcaaacagacganagtgacggggatcgaagtaggagggtatggttcgggacggaaggggaccaaaggtccgtacggaaccgtccgttaaggtccacggaccccgaagggcccgttccggccccccgttcgggtccctaaccgttccttccggtttacccccaaccccgttcccgtaaccg

SEQ ID NO: 340998 - DNA, 575 bp, Homo sapiens
  misc_feature: GZ8MTXP01CVUMZ.9.14.B03.1.454.CMB.2.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (397)..(397): a, c, t, g, unknown or other
  misc_feature (397)..(397): n is a, c, g, or t
  modified_base (542)..(542): a, c, t, g, unknown or other
  misc_feature (542)..(542): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaaatatagtttatggtaccaacagaagtcaggccaggccccccttctagtcatctatgaggacnccaggccgaccctccgggatcccctgagagaatctcgggctcagttccagggacngtcgcccaaccttgaacgagtcgggtggggcccagggtggaagngtagaagctagacttacttctagttactacaaacgagacgacagtgacggggatcgagtaggagggatgggttcggacgggaggacaagctcggaaccgtccgaggtcacggacccgaaggccgttccggccccctcgggtaccncgtcctccggttacccctaacccttcgtaaccg

SEQ ID NO: 340999 - DNA, 526 bp, Homo sapiens
  misc_feature: GZ8MTXP01B4F2A.9.14.B03.1.454.CMB.2.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgtttattggtaccaanagaagtcaggccaggccccccttntagtcatctatgaggacgccaggcgaccctcgggatccctgagagaatctcgggctccagttccagggacagtggcccaacttgcgagtcgggtgggcccagggtgaagatgaagctgactactctagttactnaacagacgacagtgcgggatcgatagaggntggtcggcgagggaccagctgaacgtcttaggtcagcccaagggcttcgcccctggtccaactctcgttccccaacccttctcg

SEQ ID NO: 341000 - DNA, 584 bp, Homo sapiens
  misc_feature: GZ8MTXP01DB8QM.9.14.B03.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcactgctctgganatggattatacaaaaaattntgtttatggtaacaacagaagtcaggccacggcccccttnagtcatctatgaggacncgaggccgaccccgtcgggatccctgagagaactcgtcgggctccagtttccgagggacaggtcggacctaaccttgaacgagtcggggtaggggcccaggggtaggaaagagtagaagctagacttacttctaggttactacaacgacgacgacaagtcgacggggtatacaagtaggaggtatggttcggacggacgggacaagctggaaccgtcttaagggtcacgacccgaaggccttcgcccccgtggtacaacgtccgtacttcccctaacccgttctaaccg

SEQ ID NO: 341001 - DNA, 589 bp, Homo sapiens
  misc_feature: GZ8MTXP01AJFK6.9.14.B03.1.454.CMB.2.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgttatggtacaanagaagtcaggccaggccccccttctagtcatctatgaggacnccaggccgaccctcggactccctgagagaatctcgggctccgagttccagggacagtggccaaccttgaaccgagtcgggtgggcccagggtggaagatgaagctagactacttctagttactcaaacagacgaacagtggacggggatccgaagtaggagggtatggttcgggacgggagggtacccaaaggctcggaacccgtccgttaagggccaacggccccgaaagggccgttcgccccccgttgggtcccaacgttcccgtcgttcccccggtaacccttcccgtaaccg

SEQ ID NO: 341002 - DNA, 545 bp, Homo sapiens
  misc_feature: GZ8MTXP01AZTQZ.9.14.B03.1.454.CMB.2.raw
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctggtgtcagtgtccccaggacagacggccaggatcacctgctctggagatggattanacaaaaaatntgttatgtacacagagtnaggccaggcccccctnagtcatctatgaggacgccaggcgacccctcgggatcccctgagagaatcgtacgggctccgagttccgaggggacaggtcggcccaacccgtttgcgagtcgggtggggacccagggtggaagatgaagctgactacttctgttactacaacagacgacagtgcggggatcgataggaggatggttcggaggaggaccaaagctaggccgtcttaggcagcccaaggccttcgccccctaaggtccaactctcgttccccgccgttcctaacg

SEQ ID NO: 341003 - DNA, 570 bp, Homo sapiens
  misc_feature: GZ8MTXP01EBURT.9.14.B03.1.454.CMB.2.raw
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (482)..(482): a, c, t, g, unknown or other
  misc_feature (482)..(482): n is a, c, g, or t
  modified_base (533)..(533): a, c, t, g, unknown or other
  misc_feature (533)..(533): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntnttatgtacanagatnagcaggcccctntagtcatctatgaggacnccaggcgacccctccggatcccctgacgagaatcgtacgggctccgacgttccgacggggacaggtcggccctaaacccgtttggaacggtagtccggggtcggggcccctaggggtacgggaaaggattaggaaagctaggacttacttctacgttactcaacgagacgacaagtcgcggggatcgaataggaggngtggttcggacggaggaccaagctgaaccgtcgttaggcagcccgaagccncgcccctgtccaactctcgttcccaaccgttcgtaac

SEQ ID NO: 341004 - DNA, 421 bp, Homo sapiens
  misc_feature: GZ8MTXP01AONKD.9.14.B03.1.454.CMB.2.raw
  modified_base (387)..(387): a, c, t, g, unknown or other
  misc_feature (387)..(387): n is a, c, g, or t
  modified_base (414)..(421): a, c, t, g, unknown or other
  misc_feature (414)..(421): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggggccagggaaccctggtcaccgtctcctcagcctccaccaagggcccatcggtccttcccccctggccgcccctgctcccgaggacgccacctccgagagcacagccggccctgggctgcctggtcaacggctactccagacgtatcnctgagcgggctgggcaaggctcatagnnnnnnnn

SEQ ID NO: 341005 - DNA, 657 bp, Homo sapiens
  misc_feature: GZ8MTXP01DLZHT.9.14.B03.1.454.CMB.2.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattaataacaaaaaaattntgtttaattggtaaccaacagaagtcaggccacggccccccttntagtcatctatgaggacgccaggccgacccctccgggatccctgagagaatcgtcgggctccgagttcccgaggggacaggtcggaccctaaaccgttggaaccggtaagtccggggtacgggggaccccctaggggtacggggaaagagtaggaaagtctagaccgttacttcgtagtttaacctacaaacgagaccgaacaggtgacggggactacgaagtagggaagggtagttcgggttcgggacggggacgggtaacccgaaaggtccgtacgaacccgttcgttagggtcgacggacccgtaagggccgttccgcccccgttggacctaaccttcgtcccgttcccctaaccccgttcctaaccg

SEQ ID NO: 341006 - DNA, 573 bp, Homo sapiens
  misc_feature: GZ8MTXP01BMVN5.9.14.B03.1.454.CMB.2.raw
  modified_base (238)..(238): a, c, t, g, unknown or other
  misc_feature (238)..(238): n is a, c, g, or t
  modified_base (274)..(274): a, c, t, g, unknown or other
  misc_feature (274)..(274): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatnttgttattggtacaacagagtcagcaggcccccttntagcatctatgaggacgccaggcgacccctccgggatccctgagagaatcgtcgggctccgagttccgagggacaggtcgcccaacccgttgcgagtcgggtggggccccgagggtacgggaagagtgaagctagacttacttctagttactcaacagacgacagtgacgggatcgagtaggagggtatggttcgggacggaggaccaagcgtgaaccggtcttagggcacgacccgaaggccgttcgttcccccgtggtccctaacgttcctcgttcccctaacccgttcctaacccg

SEQ ID NO: 341007 - DNA, 854 bp, Homo sapiens
  misc_feature: GZ8MTXP01DZ9Q4.9.14.B03.1.454.CMB.2.raw
  modified_base (252)..(252): a, c, t, g, unknown or other
  misc_feature (252)..(252): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctcgtggagagtaggtaattaataaactaaaaaaaattnttagttttaagttacggtaaaccaaacgtaaggaaacgtccgaacggaccccgacccggtccccccccttatacgtacctaacttctaagtggaacggaccgcccggaacggcccgtacccccgtacccggggactccccgtaggaacgaacgtaacgttccggtccgggcctaccgtacggttacccgaacgggggtacacggtccgggaccctaaacccgtttaggaaccgggtacggtccgggggtaccgggggaccccgaagggggttacgggaaagtagtagggtaaacgtccgttaacgtaacctttaactttaccgtttaacggtttaaacctaaccgtaaaccgaacgggtaaacccgaacgtaaagggttcgggaaccggggggtaataaccggtaaaggttaaggggaaacgggggtagttcggggttaccgggggaaacggggaacgggaaaccgtaacgtccggtacgggtaacccggtccgttaacggggtaccaaccggaccccggtaacgggcccgttcccggttaccccccgttcgggtaccctcccgttccgttcccggttcccccgtcccctttcgtaacccgg

SEQ ID NO: 341008 - DNA, 687 bp, Homo sapiens
  misc_feature: GZ8MTXP01B40G2.9.14.B03.1.454.CMB.2.raw
  modified_base (248)..(248): a, c, t, g, unknown or other
  misc_feature (248)..(248): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtgtccccaggacagacggccaggactcacctgctctggagatggtaattaataactaaaaaaaattnttagttttaacttacgggtaaaccaaacgaaggaaacgtcgacggcccaacggtccccccttatacgtaccatctaatgacggacgccgacggccgacccgtccgggaactcccgtagagagaacgtcgtcgggctccgtagttaccgacgggactacggtcggaccctaaacgttcggaacgtacgtcgggggtcggggaccccgaagggtaggaaagagtaggaagcgtacggaccttacttcgttacgtttaacacaacgaacggacgacgaaggtgacggggtattacgaagtagggagggagttcggtacgggacgggaggaacccgtaagcgtacgaacccgtcgttacggtacgaccgaccggaacgccgttcccgcccccgttcggtacctcccttcccgtcccggttacccctaaccccgttctaacccg

SEQ ID NO: 341009 - DNA, 668 bp, Homo sapiens
  misc_feature: GZ8MTXP01BBFHK.9.14.B03.1.454.CMB.2.raw
  modified_base (246)..(246): a, c, t, g, unknown or other
  misc_feature (246)..(246): n is a, c, g, or t
  modified_base (567)..(567): a, c, t, g, unknown or other
  misc_feature (567)..(567): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctggtgtcagtcgtccccaggacagacggccaggatcacctgctctggagatggaattaataactaaaaaaaattnttagttttaattaggtaaccaacgagaagtcaggccacggccccccttgtacgtcatctagtgaggacgccgacggccgtaccccgtacgggactcccgtagacgagtaatccgttcgggctccgtacgttaccgacgggacgaggtccggaccctaaccgttacgaacggtacggtccggggtacggggaccccgtaaggggtacgggaaagagtacgaagtcgtacggtaccttacttcttagttacctacgaacgagaacgacagtcgacgggatcgaagtaggaggtgtcggtcgggacgggacggacgaacggtcncggtaacccgtcgttacggtaccgacgacccgaagggttcccttccggcccccgtcgtccgtaaccttccgtccgttacccctaacccctttcgtaacccg

SEQ ID NO: 341010 - DNA, 699 bp, Homo sapiens
  misc_feature: GZ8MTXP01A0KLL.9.14.B03.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctcgtggagatggaattataactaaaaaaattnttagtttattaggtaaccaaacagaagtcacggccacggtccccccttntagtcatctatgaggaccgccgacggccgaccccgtccgggatccccgtgagagaatcgtccgggctcgagttccgagggacaggtcgccctaaacgttcggaacgagtcggggtcggggacccgaggggtaggaaagtagtgaagctaggtaccttacttcgttacgttactacaacgagtaacgacgtagtcgacggggtataccgaagtagggaagggtagtgggttaccgggacggggtaacggaaccgtaaaggtccgtacgggtaacccggttaccgttacgggtccgaccggacccggtaaacgggttcccgttcccgggcccccccggttccggtaccccgtaacccgtttcccggttcccgggtttccccccccgtccccgttcccgtaacccgg

SEQ ID NO: 341011 - DNA, 595 bp, Homo sapiens
  misc_feature: GZ8MTXP01EAIGY.9.14.B03.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtcgtccccaggacagacggccaggatcacctgctctgganatggattatacaaaaatntgttatgacananannagcngcccctngcanctatgagacgcagcgaccctcggatcctgagagatctacggctcgagttccgagggacaggtcggcccaacccgttgaaccgtagtccggggtcggggacccaggggtaggaaagagtagaagctaggacttacttcgtagtttaactacaaaccgagaacgacaaggtcgacgggggaatcgaagttaggagggatggttcggacggggacgggaccaaggtctacggaacccgtcgttagggtcaacggacccgaacggccgttccggcccccgtcgggttccaacccgttccgtaccgttccccggtccccttccgtaaccgg

SEQ ID NO: 341012 - DNA, 570 bp, Homo sapiens
  misc_feature: GZ8MTXP01DKQ5X.9.14.B03.1.454.CMB.2.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgttatgtacanagatcagcagccccctnagtcatctatgagacncagcgaccctccggatccctgagagaatcgtcgggctccagttccagggacaggtcggccctaaccgttgaacgagtcggggtcggggaccccgagggtacgggaaagagtagaagctagactacttctagttactacaacgagacgacagtgacggggatcgaagtaggaggatggttcgggacggaggaccaaggctggaaccgtcgttaggtcacgacccgaaggccgttccgcccccgttcggtccaaccgttccgtccgttccccgtcccgttcctaacccg

SEQ ID NO: 341013 - DNA, 818 bp, Homo sapiens
  misc_feature: GZ8MTXP01AYPA2.9.14.B03.1.454.CMB.2.raw
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
  modified_base (290)..(290): a, c, t, g, unknown or other
  misc_feature (290)..(290): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcacttttctgcacagtctctgaggcctcctatgatctgacacagccaccctcggtntcagtgtccccaggacagacggccaggatcacctgctctggagatggaattaataacaaaaaaaattnttagtttataggtaaccaacagaagtcaggccacggcccccttntagtcatctatgagacgccaggccgacccctccgggacttccccgagacgaagtaacgtcgtaccgggctaccgtagttaccgacgggtaacgacggtacgacccgtaacccgtttaggaaccggtacgtccgggggttacgggggacccccgtaagggggttacgggaaaggtaagttacgggaaacgtcccgttaaggtaacctttaaccttttcgttaacggttttaaaccctaccgaaaacgaaacggtaacccgtaaacaagggttaccgaggggggtaaacctcggtaaaagttaacggggaaaggggttaagttccgggggttaacgggaacccgggggaacggggtaaaccccgaaaagggtccgtaaccggggtaaaaccccgttccccgtttaaagggggtacccaaaccgggacccgttaaaccgggggcccttccccgggttcccccccggtaacgggttaccctaacccttcccggttacccgttaccccccctaacccgttccccttaacccgg

SEQ ID NO: 341014 - DNA, 639 bp, Homo sapiens
  misc_feature: GZ8MTXP01A8B63.9.14.B03.1.454.CMB.2.raw
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcacttttctgcacagtctctgaggcctcctatgatctgacacagccaccgtcggtgtcagtcgtccccaggacagacgccaggactcacctgctcgtggagataggtaattaataaactaaaaaaaattnttagttttattacggtaaccaacgaagaacgtcgacggcccgacggtccccccttntacgtacatctagtaggacggaccgccgacggcccgaccccgtcgggactcccgtagagacgtaactcgtcgggctcgagttccgagggtacngtcgcctaacgtgaacgtacgtcggggtcgggaccgtagggtacggaaagagtacgaagtcgtagtacttacttcgtacgttacacaacgacgacgaacgaggtgacggggtatacgagtagggacggtagtcgggtcgggacgggaacggtaccaagtccgtcgaaccgtcgttacggcacgcccgaagttccgcccgttcccgtcggactcctccgtcgttccccgccttcgaacg

SEQ ID NO: 341015 - DNA, 754 bp, Homo sapiens
  misc_feature: GZ8MTXP01AKJ4N.9.14.B03.1.454.CMB.2.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (276)..(276): a, c, t, g, unknown or other
  misc_feature (276)..(276): n is a, c, g, or t
  modified_base (734)..(734): a, c, t, g, unknown or other
  misc_feature (734)..(734): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtcgtccccaggacagacggccaggatcacctgctctgganatggattanacaaaaaatntagttatgtacaacagaagtcagccacggcccccttntagtcatctatgagacgccgaggccgaccccgtcgggactccccgtaggacgaagaactcgtcgggggcctccgacggttccgaggggacaaggtcggccctaaaccgttcgggaacggtacgttccgggggcggggacccccgaaggggttacggggaaaagtagttaggaaaacgtcgttacggtaactttaccgtttacgttacggtttaacctaacaaaccgaaggaaccgaacctaagggttcggaccgggggtaaattccgaaagttaacggggaaggggtacgttcgggttaccgggggaaccggggtacggggtaaacccgaaagggtccgttaacgggtaaccccgttaccggttaacgggtaccgaaaccggaccccggtaaacgggcccgttacccggcccccccggttcgggtaccctcccgttacccgttcccggtttacccccncccctttaacccgtaacccg

SEQ ID NO: 341016 - DNA, 557 bp, Homo sapiens
  misc_feature: GZ8MTXP01A5M6E.9.14.B03.1.454.CMB.2.raw
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccacctcggtgtcagtgtccccaggacagacggccaggatcacctgctctggagatggaattaataacaaaaaaaattnttagtttaattggtaaccaaacagaagtcaggccacggccccctntagtcatctatgagacgcaggcacctcggactcctgagagatcgtcggctcagtccgagggacagtcggcctaaccttgaacgatcgggtcggggcccagggtggaaagatgaagctagactactnttagtactacaaacngaacgacagtgaggggactanagaggagngtggtcggaggacggaaccgagcgtcgaacgtcgttagcaccgaccgaacgccgttccgccccgtcgtctccttccgtccgttcccctcccgttcgtcg

SEQ ID NO: 341017 - DNA, 609 bp, Homo sapiens
  misc_feature: GZ8MTXP01AV7ME.9.14.B03.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctctgganatggattaataacaaaaaattnttagtttatggtaaccaanagaagtcaggccacggcccccttntagtcatctatgagacgccgaggccgacccgtccgggactcccgtagagagactcgtcggcctcgagttccgaggacagtcgaccctaaccgttgaacgtacgtcggggtcggggccaggggtcggaaagagtagagcgtagtactacttctagttacacaacgagacgacgagtcgacggggtatacgaagtaggagggtatcgggttacggacgggacggtaaccgaagcgtcggaacccgtcgttaggtccacgcccgaacggcgttccgcccccgtcggtcctaacctccgtcccgttacccctaaccgttccctaacg

SEQ ID NO: 341018 - DNA, 637 bp, Homo sapiens
  misc_feature: GZ8MTXP01CQEX7.9.14.B03.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (598)..(598): a, c, t, g, unknown or other
  misc_feature (598)..(598): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctgganatggaattataacaaaaaaaatnttagtttaattggtaaccaaacagaagtcaggcccacggtccccccttntagtcatctatgaggacgccaggccgacccgtccggactccctgagagactcgcggctcagtcaggcngngcctacgttgcgagtcgggtggggccagggtagaagagtagaagctagacttacttcgtagttacctacaaacgaggacgaacgaggtacggacgggggtaatacgtaagtaacgggaggggtatcggggttacgggacggggaacggggtaaaccaagggtccgtacggaacccgttcgttagggtaccaccggtaaccccgagggttcccttcccggttacccccgtgggtcccnccgttcccttcccggttacccccaaccctttcgaacccg

SEQ ID NO: 341019 - DNA, 440 bp, Homo sapiens
  misc_feature: GZ8MTXP01E4ASK.9.14.B03.1.454.CMB.2.raw
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
  modified_base (434)..(440): a, c, t, g, unknown or other
  misc_feature (434)..(440): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataaccccgttcgcctggttattaccttgacacgttgggggccagggaaccctgggtcacccgtctcctcacgcctccaccgaagggcccatccggtccttcccccgtggccgcccctgcctccgaggacgccaccctccgagacgcacacggccggcccgtggggctgccgtggtacaaacggactactccgagacgtaatcngtgaggcgggctggcaagggcncatagnnnnnnn

SEQ ID NO: 341020 - DNA, 881 bp, Homo sapiens
  misc_feature: GZ8MTXP01DDS8N.9.14.B03.1.454.CMB.2.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
tcagtgatacgtctcacgaccggtgctcgatttagtgtgagtagttccgcggggggtgggctcaggaggcagagctctgggaatctcaccatggcctggacccctctcctgcctccccctcctcactttctgcacagtctctgaggcctcctatgatctgacacagcccaccctcggtgtcaggtcgtccccgaggacaggacggccaggatcactgctcgtgganataggtaattaataaactaaaaaaaattntttagttttaagttacgggtaaacccaaagaaggaaagtaccgacggacccaaccggtcccccccttatacgtactactctagaggacggacgccgacggccgtaccccgtccggacgtccctaggaacggtaacgaacttccggtaccgggggtccctaccggtaacggttacccggaaacgggggtaccgtaacgggttccgggaacccccttaaaccgggtttacggaacccggggtaacgggttcccggggggtccggggggaccccgtaagggggtaacgggggaaagtacgaggtacggtacgtacggtaaacgttaccgtttctacggttttaaccaacgaaaccgtaggaaccgtaaacgggtacggtacgggacggggtaacgtaacgggtaaggtaagggggtaacgggttacgggttaccgggggtaccgggggaaccgggggtaacgggtaaacccggtaacggtaccggtaccccggtaacccggttaccggttacgggtacccgaacccggaacccggtacgggttccccgttccccggggttacccccgttaacggtcccgttaacccgttccccgttaccccgttaccccctaaccccgttcccgtaacg

SEQ ID NO: 341021 - DNA, 678 bp, Homo sapiens
  misc_feature: GZ8MTXP01BQBTZ.9.14.B03.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagcccaccctcggtgtcagtcgtcccccaggacagacggccaggatcacctgctcgtgganataggattaanaactaaaaaaattnttagtttaatacggtaaaccaacgaagaagtacgacggaccaccggtccccccttagtacgtcatactagtgaggaccgccgacggccgaccccgtccgggactccccgtagacgagaactcgtcggctaccgtacgttcgacgggactacggtcggaccctaaccgttagaacggtacggtccggggtcggggacccctaggggtacgggaaagagtaggaaagtctagaaccttacgttcgttacggttactacgaaacgacgaacgacgtagtcggacggggtatacgagtagggaaggtagtcggttacgggacggacggtaccgagtcgtacgcccgtacgttacgtcgaccgacccgtaagttccgttcccggttacccgtcggtcctccgttccgtccgttaccccgtcccgttcctaaccg

SEQ ID NO: 341022 - DNA, 518 bp, Homo sapiens
  misc_feature: GZ8MTXP02JRX43.9.14.B03.1.454.CMB.2.raw
  modified_base (276)..(276): a, c, t, g, unknown or other
  misc_feature (276)..(276): n is a, c, g, or t
  modified_base (504)..(504): a, c, t, g, unknown or other
  misc_feature (504)..(504): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttatggtaccaacagaagtcaggccaggcccccttntagtcatctatgaggacgccaggcgaccctccgggatccctgagagaatctcgggctccagttccagggacagtggccaccttgcgatcggtggggcccagggtggaagatgaagctgactacttctgttactcaacagacgacagtgcggatcataggaggatggttcggcggaggaccaagctgaccgtcctaggtcagcccaggcctcgccccctggtcacgtcncgttcccgcctctc

SEQ ID NO: 341023 - DNA, 511 bp, Homo sapiens
  misc_feature: GZ8MTXP02G6MP8.9.14.B03.1.454.CMB.2.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (442)..(442): a, c, t, g, unknown or other
  misc_feature (442)..(442): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctgganatggattatacaaaaaatntgttatggtacaanagagtcagccaggcccccttntagtcatctatgaggacnccaggcgaccctcgggatcccngagagaatcncgggctcagtccagggcagtggccaccttgacgatcgggtggggcccagggtggaagatgaagctgactacttctgttactcaacagacgacagtgcggatcataggaggatggtcggnggaggaccaagctgaccgtcgaggtcagcccaaggctcgcccctcgtcactcgtcttcccacctcctcg

SEQ ID NO: 341024 - DNA, 527 bp, Homo sapiens
  misc_feature: GZ8MTXP02GXHTD.9.14.B03.1.454.CMB.2.raw
  modified_base (218)..(218): a, c, t, g, unknown or other
  misc_feature (218)..(218): n is a, c, g, or t
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctgganatggattatacaaaaaatatgtttatggtaccaacagaagtcaggccaggcccccttntagtcatctatgagacgccaggcgaccctcggatccctgagagaatctcgggctccagttccaggggacagtcggccacgttgacgagtcgggtgggggcccagggtcggaaagntgaagctgactatctgtactnaacagacgacagtgcggatcataggaggatggttcggnggagggaccaagctagaccgtcaggtcaagcccaaaggcctcgccccctggtcacgtctcgttcccaccctcctacg

SEQ ID NO: 341025 - DNA, 537 bp, Homo sapiens
  misc_feature: GZ8MTXP02GB0YJ.9.14.B03.1.454.CMB.2.raw
tcagtgatacgtctcacgaccggtgctcgatttagtgtgagtagtttgggtttgtggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccattcaccatctccagggacaacgccaagaactcactgactttgacaaatgaaacaccctgcgagccgaggacacggccgtatattactgtgcgagaaataacccgttcgcctgttattaccttgacacttgggggccaggggaaccctggtcaccgtctcctcagcctccaccaacgggcccatccggtccttccccctggccgccctgcctccgaggagccacctccgagagcacagccggccctgggctgcctggtcaaggactactccagacgtaatcactgagcggctgcg

SEQ ID NO: 341026 - DNA, 405 bp, Homo sapiens
  misc_feature: GZ8MTXP02I77BD.9.14.B03.1.454.CMB.2.raw
  modified_base (375)..(375): a, c, t, g, unknown or other
  misc_feature (375)..(375): n is a, c, g, or t
  modified_base (401)..(405): a, c, t, g, unknown or other
  misc_feature (401)..(405): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggcccatcggtctcccctggcgccctgctccaggagcacctccgagagcacagcggccctgggcctgcctggtcaaggactactccagacgtatcnctgagcgggctggcaaggcgcatagnnnnn

SEQ ID NO: 341027 - DNA, 623 bp, Homo sapiens
  misc_feature: GZ8MTXP02JVRP0.9.14.B03.1.454.CMB.2.raw
  modified_base (283)..(283): a, c, t, g, unknown or other
  misc_feature (283)..(283): n is a, c, g, or t
tcagtgatacgtctcacgaccggtgctcgatttagtgtgagtagttccgcgggggtgggctcaggaggcagagctctgggaatctcaccatggcctggacccctctcctgctcccctcctcactttctgcacagtctctgaggcctcctatgatctgacacagccaccctcggtgtcagtgtccccaggacagacggccaggatcacctgctctggagatggattataacaaaaaatattagtttattggtaaccaacagaagtcaggccacggccccccttntagtcatctatgaggacgccaggccgaccctccgggatccctgagagaatcgtcgggctccgagttccgagggacagtggccacttgcgatcgggtggggcccagggtggaaagagtagaaagctaggactacgttcttagttacctacaaacgacgacgtaacaggtgacggatacgaagtagggagggtattgggttacgggacggggaacgggaccgaaacgtcgtacggacccgttaccgttaggtccgaacggaccccgaacgggccctccggtccccccgtcgggtcctaacccgttccgttacccgttccccctaccccgttccctaacccgg

SEQ ID NO: 341028 - DNA, 556 bp, Homo sapiens
  misc_feature: GZ8MTXP02GRWOP.9.14.B03.1.454.CMB.2.raw
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
  modified_base (319)..(319): a, c, t, g, unknown or other
  misc_feature (319)..(319): n is a, c, g, or t
  modified_base (537)..(537): a, c, t, g, unknown or other
  misc_feature (537)..(537): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgttatggtacaacagaatcaggcaggccccctnagtcatctatgagacgccaggcgaccctcgggatccctgagagaatcncgggctccagttcccagggtacagtggccaccttgaccgatcgggtgggccccgagggtaggaaagagtagaaagctaggaactaacttcttagttacctcaaacgagacgacaaggtgacgggaatcaagtaggaggatggttacgggcggaagggaccaaagcgtgaaccggtctaagttcgaacgcccaacggctccgccccctggtcaccttcncgttcccccgcctactccg

SEQ ID NO: 341029 - DNA, 521 bp, Homo sapiens
  misc_feature: GZ8MTXP02GB74A.9.14.B03.1.454.CMB.2.raw
  modified_base (279)..(279): a, c, t, g, unknown or other
  misc_feature (279)..(279): n is a, c, g, or t
  modified_base (433)..(433): a, c, t, g, unknown or other
  misc_feature (433)..(433): n is a, c, g, or t
  modified_base (498)..(498): a, c, t, g, unknown or other
  misc_feature (498)..(498): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccaggccccccttntagtcatctatgaggacgccaggccgaccctccgggatccctgagagaatctcggggctccagttccaggggacagtcggccaccgttgcgatcgggtggggcccagggtggaagatgaagctgactacttctgttactcaacagacgacagtnacggatcataggaggatggtcggcggaggaccaagctgaccgtctaggcagccaggctcgccccngtcactctcgtcccacctctacg

SEQ ID NO: 341030 - DNA, 601 bp, Homo sapiens
  misc_feature: GZ8MTXP02GPRSG.9.14.B03.1.454.CMB.2.raw
  modified_base (570)..(570): a, c, t, g, unknown or other
  misc_feature (570)..(570): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccaggccccccttctagtcatctatgaggacgccaggccgaccctccggactcccgtgagagaatcgtacgggctccgagttccgagggaccaggtcggcctaccgttgacggtagtcggggtcggggccccgagggtagggaaagtagtagaaacgtctacgacttactttcgtacgttacctacaaacgtaagacgaacgtagtggaccggattacgaagtagggagggagttggttacgggacgggaagggaccgaagcgtacggaccgtccgtaggtcacgccgaacggcctccgccccgnggtccacgttctccgtcccacccgtcctacg

SEQ ID NO: 341031 - DNA, 677 bp, Homo sapiens
  misc_feature: GZ8MTXP02FEKTE.9.14.B03.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (485)..(485): a, c, t, g, unknown or other
  misc_feature (485)..(485): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagcccaccctcggtgtcagtcgtccccaggacagacggccaggatcacctgctctgganatggaattaataacaaaaaattntagtttaataggtaccaacagagtcacggccacggcccccttnagtcatctangacggacgccgaggccgacccgtcggactcccgtagaagagaacgttccgtcggggctcccgtaggttcccgaggggtacaggtcggaccctaaccgttggaccggtacgtcggggtcgggggacccaggggttaggaaagataggaaacgtcgtagtactttaacttcttagttaaccacaaacgngaaccgagagtgacggatcgaagttagggaggacgttgggtaccgggacggggacgggaacccctaaggtccgaacggtaccccggtacgtacgggtccaaccggaccccgaagggtcccctcccggtccccccgttgggacccttaacccgttcccttcccggtttacccccaacccccttcgtaaacccg

SEQ ID NO: 341032 - DNA, 557 bp, Homo sapiens
  misc_feature: GZ8MTXP02JVLL4.9.14.B03.1.454.CMB.2.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (425)..(425): a, c, t, g, unknown or other
  misc_feature (425)..(425): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatntgtttattggtaccaacagaagtcaggccaggccccccttntagtcatctatgaggacgccaggcgaccctccgggatcccctgagagaatcgtcgggctccagttccagggacagtggccacttgacgagtcggtggggcccagggtcggaagagtgaaagctaggactacttctgttactcaacngacgacgagttgacggatcgagttaggaggtatcggttcggcggtagggaccaagcctagaccgtcgtaaggtccacgcccgaaaggcctacggccccctaaggtcaccgtctcgtccccaccgtcctaccg

SEQ ID NO: 341033 - DNA, 582 bp, Homo sapiens
  misc_feature: GZ8MTXP02FXJIR.9.14.B03.1.454.CMB.2.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattanacaaaaaatntgttatgtacaacagagtcagccacggccccctctagtcatctatgagacgccaggccgaccctccggatcccctgagagaatcgtcgggctcctagttccgaggacagtcggccaccgttgacgagtcggggtggggaccccagggtagggaaagagtgaaagctagaactacttctagttactacaaacagaacgacaggtgcggatcaataggagggatgggttcggcggaaggaccgaagtcgtacggaccgtcgtacggtcgaacgacccgaacggtcctccgtcccccgtcgggtcccaaccgttccgtccgtttacccccaccccgttccctaaccg

SEQ ID NO: 341034 - DNA, 646 bp, Homo sapiens
  misc_feature: GZ8MTXP02JFRQE.9.14.B03.1.454.CMB.2.raw
  modified_base (279)..(279): a, c, t, g, unknown or other
  misc_feature (279)..(279): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccacggccccccttntacgtcatctatgaggacgccaggccgaccctccgggactcccgtagagagaatcgtcggctccagttccgagggacagtcggcctacttgacgagtcgggtggggacccgagggtaggaaagagtgaaagcgtagtactactttctagttacctacaacgagacgaacgagtggcggtaatcgaagtagggaaggggattgggttaccggggacgggtaacgggaccgaaaggccgtacggtaaccccggtccgttaacggggtccaaacggcccgaaacgggtcccgtccccggtaccccccgttcgggtaccctaacccgttcccgttacccggttccccctaacccccgttccttaaccccgg

SEQ ID NO: 341035 - DNA, 589 bp, Homo sapiens
  misc_feature: GZ8MTXP02F6SCB.9.14.B03.1.454.CMB.2.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (498)..(498): a, c, t, g, unknown or other
  misc_feature (498)..(498): n is a, c, g, or t
  modified_base (577)..(577): a, c, t, g, unknown or other
  misc_feature (577)..(577): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctcgtggagatggaattaataacaaaaaaaattnttagttttaattacggtaaccaaacagaagtcaggccacggccccccttntagtcatctatgaggacgcaggccgacccgtccggatcccgtgagagaatcgtcgggctccgagtccgagggacagtcggccaccgttgacgagtcggggtcggggcccaggggtggaaagatagaaagctagtacttacgttctagttacctacaaacagaacgacagtcggacggatcgagtaggaggagtggtcgggnggaacggacaaggcacggaccgtcgaggtcacgacccgaagccgtccgccccgtggtccaccgttcgtccgttaccccnccctacctaccg

SEQ ID NO: 341036 - DNA, 518 bp, Homo sapiens
  misc_feature: GZ8MTXP02FISFZ.9.14.B03.1.454.CMB.2.raw
  modified_base (280)..(280): a, c, t, g, unknown or other
  misc_feature (280)..(280): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaaatatgtttattggtaccaacagaagtcaggccaggccccccttntagtcatctatgaggacgccaggcgaccctccgggatccctgagagaatctcgggctccagttccagggacagtggccaccttgacgatcggtggggcccaggtggaagatgaagctgactacttctgtactcaacagacgacagtgcggatcatagaggatggtcggcggaggaccaagctgaccgtctaggtcagcccaagcctcgcccctggtcacgtctcgttcccacctctcg

SEQ ID NO: 341037 - DNA, 571 bp, Homo sapiens
  misc_feature: GZ8MTXP02J2VYX.9.14.B03.1.454.CMB.2.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
  modified_base (550)..(550): a, c, t, g, unknown or other
  misc_feature (550)..(550): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtccagtcgtccccaggacagacggccaggatcacctgctctggagatggattanacaaaaaatntgtttatggtaccaanagagtcagccaggcccccctntagtcatctatgaggacncaggccgacccncgggactccctgagagactcgtcggcctccgagttcccgagggtacaggtcggcctaccgttggacgngtcggggtcggggcccagggtggaaagatagaaagctaggaacttacttctacgtttacacaaacgacgacgacgaggttgacggatcgagttagggagggtatgggttcgggacggtacgggaccaagccgtagacccgtctagggccacgcccgagcctccgccccgtggtcncctcgtctccccacctctacg

SEQ ID NO: 341038 - DNA, 582 bp, Homo sapiens
  misc_feature: GZ8MTXP02IN1MF.9.14.B03.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatnttagttattggtaccaanagaagtcaggccacggcccccttntagtcatctatgagacgccgaggccgacccgtccgggatccccgtgagagaatcgtcgggctccagttccgagggacaggtggccaaccttgacggatcggggtcggggcccgagggtggaaagagtagaagctagactacgtttctgttactacaacagacgacagtgacggatacgagtaggaggtagtagggttcgggacgggacgggaccaaggcgtacggtaccgtccgtaggtacacggacccgaacggcctccgcccccgtcggtcaccgtccgtcgtccccctaccctccctcg

SEQ ID NO: 341039 - DNA, 545 bp, Homo sapiens
  misc_feature: GZ8MTXP02HI7W5.9.14.B03.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (359)..(359): a, c, t, g, unknown or other
  misc_feature (359)..(359): n is a, c, g, or t
tcagtgatacgtctcacgaccggtgctcgatttagtgtgagtagttccgcggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctgganatggattanacaaaaaatnttgtttatggtaccaacagaatcagccagccccctntagcatctatgagacgccaggcacccgtcggatcccgtgagagaatcgtcggctccagtccagggacagtcggccaccgttgacgngtcggcggaccgagggtagaaagagtagaacgcgtagtacttacttcgttagttactacaaacgagacgaacgagtagacgatagagtagagagtaggtacggacggacggacgaacgacgacgtacgtacgtacgacgacgacgacgacgtccgcccgtccgtctactctcgtcctacgtcctcc

SEQ ID NO: 341040 - DNA, 752 bp, Homo sapiens
  misc_feature: GZ8MTXP02GRMLU.9.14.B03.1.454.CMB.2.raw
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattataacaaaaaaatnttgtttatggtaccaaacagaagtcaggccacggccccccttntagtcatctatgaggacgccaggccgaccccgtccgggactccccgtgacgagaactctacggggcctccgtagttcccgaacggggaccaaggtcgggacccctaccgtttggaccgtagttcggggtacgggggcccccgtaaggggttgggaaaaggtagttaggaaaacgtccgttaggtaacctttaaccgtttccgttaggttttaaaccccttaacgtaaaaccgaacggtaaacccgaaacgtaacggggttacggaacccggggtaatttaccgaaaagtttaacgggggaaggggtaaccgttggggtttaccggggacggggtaaacgggaaccgaaacggtcgtacggtacccggtacgtacgggtacacggaccccgtaaaggccctcccggtaccccccgtcggggtccctaaccgttcccgtccgtttcccccggccccttacccgttaacccg

SEQ ID NO: 341041 - DNA, 704 bp, Homo sapiens
  misc_feature: GZ8MTXP02GVVH8.9.14.B03.1.454.CMB.2.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
tcagtgatacgtctcacgaccggtgctcgatttagtgtgagtagttccgcgggggtgggctcaggaggcagagctctgggaatctcaccatggcctggaccccctctcctgcctccccctcctcactttctgcacagtctctgaggcctcctatgatctgacacagccaccctcggtgtcagtcgtccccaggacaggacggccaggatcacctgctctggagatggattaataacaaaaaaattnttagtttattaggtaaccaaacagaagtcaggccacggccccccttntagtcatctatgaggacnccgaggccgacccgtccgggactccccgtgaagagaactcgtaccgggcctaccgtagttccgagggactaggtcggaccctaccgttgaccggtagtcggggtacgggggacccaggggtaggaaagagtagaagtctagtaactacttctagttacctacaaacgagaacgaacgagtacggacggattacgaagttagggaggtagttggttacggggacgggaacgggaacccgaaggtacgaccggaaacccgttccgttaaacgggtaccgaaccggtaccccggaaaacggtccccgtacccggtcccccccggttaacgggttcccaaaccccgtttcccgttcccccggtttaccccctacccccggtttaccctaaccccggg

SEQ ID NO: 341042 - DNA, 415 bp, Homo sapiens
  misc_feature: GZ8MTXP02GWX34.9.14.B03.1.454.CMB.2.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (380)..(380): a, c, t, g, unknown or other
  misc_feature (380)..(380): n is a, c, g, or t
  modified_base (409)..(415): a, c, t, g, unknown or other
  misc_feature (409)..(415): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccaggggaaccctggtccaccgtctcctcagccctccaccaaggcccatcggtctcccctggcnccctgctccagganccacctccgagagcacagccggccctgggctgcctggtcaacggctacttccagacgtatcnctgagcggggctgggcaagggcgcatagnnnnnnn

SEQ ID NO: 341043 - DNA, 682 bp, Homo sapiens
  misc_feature: GZ8MTXP02JGYXL.9.14.B03.1.454.CMB.2.raw
  modified_base (239)..(239): a, c, t, g, unknown or other
  misc_feature (239)..(239): n is a, c, g, or t
tcagtgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattataacaaaaaatntgtttatggtaccaacagaagtcaggccacggccccccttctagtcatctatgaggacgccgaggccgacccgtccgggactccctgagagaatcgtcgggctccgagttccgagggacaggtcggcctaccgttgacgtagtccggggtcgggggaccccgtaggggtagggaaagagttaggaaagtcgtagaacgttacctttcgttagttaactaccgaaacgtacgacgacgtaggttggacgggtaataccgaagttaagggaaggggtagttcggggtttacggggacggggaacggggaccgtaaaggccgttacggtacccggttccgtaacgggtaccgaacggaccccgaaacgggccctaccggaccccccgttcgggtaccctaaccgttccgttcccggttaccccctacccccgtttccctaacccgg

SEQ ID NO: 341044 - DNA, 681 bp, Homo sapiens
  misc_feature: GZ8MTXP02GWXIM.9.14.B03.1.454.CMB.2.raw
  modified_base (243)..(243): a, c, t, g, unknown or other
  misc_feature (243)..(243): n is a, c, g, or t
  modified_base (287)..(287): a, c, t, g, unknown or other
  misc_feature (287)..(287): n is a, c, g, or t
  modified_base (664)..(664): a, c, t, g, unknown or other
  misc_feature (664)..(664): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctctggagatggattaataacaaaaaattnttagtttataggtaacaacagaagtcacggccacggcccccttntacgtcatctatgaggaccgccgacggccgacccgtccggactcccgtgaagagaactcgtacgggctaccgtagttccgagggacaggtcggaccctaccgttagacgtacgtcgggggtcggggacccgaggggtaggaaagagtaggaaagcgtagaacttacttcgttacgttaaccgtacaaacgacgaacgaacgtagtcggacggtactacgaagtaagggagggtaagttcgggttacgggacggggaacgggaaccaaacgggtcgtaccggtaccgtaccggttacggtaccgaaccggacccgaaacggcccgtacccggtaccccccggtggtacccgtaccttcccgttcccggttaacccccnccccgttaccctaaccg

SEQ ID NO: 341045 - DNA, 709 bp, Homo sapiens
  misc_feature: GZ8MTXP02HCJC1.9.14.B03.1.454.CMB.2.raw
  modified_base (246)..(246): a, c, t, g, unknown or other
  misc_feature (246)..(246): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtcccaggacagacggccaggatcacctgctcgtggagatggtattaataactaaaaaaattnttagtttaattacggtaaccaaacagaagtcacggccacggtccccccttatacgtcatctatgaggacgccgacggccgacccgtcggactcccgagagacgtaatcgtcgggcctaccgtaggttacccgaacggggacctacgggtcggtacccctacgtttacggaccgtacggtcgggggtaccggggaccccgtaggggtaggaaacgagtacgaagtccgtagaaccttacgttccgttacggtttaacacgtaaacgacggacgaacgtaagtcggacggtaactacgtaagtacgggagggtaacgttcgggtacggggacgggaacgggaccgaacggcgtacggtaccggtaccgttagggacctaccgggacccaacgggtcccgtacccggcccccgttccggacctacccgttcccttacccggtccccctaccccgttaccgtacccg

SEQ ID NO: 341046 - DNA, 631 bp, Homo sapiens
  misc_feature: GZ8MTXP02JDYCO.9.14.B03.1.454.CMB.2.raw
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (423)..(423): a, c, t, g, unknown or other
  misc_feature (423)..(423): n is a, c, g, or t
tcagtgatacgtctcacgaccggtgctcgatttagtgtgagtagttccgcgggggtgggctcaggaggcagagctctgggaatctcaccatggcctggacccctctcctgcctccccctcctcactttctgcacagtctctgaggcctcctatgatctgacacagccaccctcggtgtcagtcgtccccaggacagacggccaggatcacctgctctggagatggattaataacaaaaaaatattagtttaattaggtaaccaaacaagaagtcgaggccacggcccccttntagtcatctatgagacgcaggccgaccctcggactcccgngagagaactcgtcgggctaccgagttcccgagggacagtcggacctaccgttagaccgtagtcgggtcgggggacccaggggtagaaaggntagaaagcgtagaacgtacttcgtagttacctacaaacgagacgacaggtgcggatcgaagtagggaagggagttcgggtcgggacggggtaacggaacccgaaagtccgacggtacccgtacgttaacgggtaccacggaccccgaaggtcccgtcccgaccccccgtggtaccaccgttccgtccgtaccccctacccgtctaccg

SEQ ID NO: 341047 - DNA, 466 bp, Homo sapiens
  misc_feature: GZ8MTXP02H3M6S.9.14.B03.1.454.CMB.2.raw
  modified_base (430)..(430): a, c, t, g, unknown or other
  misc_feature (430)..(430): n is a, c, g, or t
  modified_base (453)..(466): a, c, t, g, unknown or other
  misc_feature (453)..(466): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaactaacccgttcgccttggttattaccttgacacgttggggaccaggggaaccctggtcaccgttctcctcacgcctccaccgaaggcccatcggtccttcccctcggcgcccctgctccaggacgcacctccggacgagcacaggccggccccgtgggcctgccccgtggtacgtaacggacttaccctttaccgaacgtacgtacttcaccgtggaggcccggggntgggcgaaacgggtccacatagnnnnnnnnnnnnnn

SEQ ID NO: 341048 - DNA, 676 bp, Homo sapiens
  misc_feature: GZ8MTXP02HO8PQ.9.14.B03.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (366)..(366): a, c, t, g, unknown or other
  misc_feature (366)..(366): n is a, c, g, or t
  modified_base (452)..(452): a, c, t, g, unknown or other
  misc_feature (452)..(452): n is a, c, g, or t
tcagtgatacgtctcacgaccggtgctcgatttagtgtgagtagttccgcgggggtgggctcaggaggcagagctctgggaatctcaccatggcctggaccccctctcctgctccccctcctcactttctgcacagtctctgaggcctcctatgatctgacacagccaccctcggtgtcagtcgtccccaggacagacggccaggatcacctgctcgtggagatggaattataacaaaaaatnttagtttataggtaaccaanagaaagtcagcccacggcccccttntacgtcatcctatagaggccgccgaggccgacccgtcggactcccgtgagagatcgtcgggctccgagttcgaggacnggtcgacacccgttgcgaggtcgggtcggggcccgtaaggggtcggaaagtatggaagcgtagtactacttattcggtttaactanaaaccgtagaacgaacaggtacgcgtatacgtagaggagggtagtcggttacgggacgggacgggaactaaacgggtcgtaccggtaaaccggttccggtagggtaccctacggaacccggtacggtaccccgttacccggccccccggttaaccgggttccggtaaacccctttaccggttcccggtttaccccccgaaaccccctttccccgttaaacccgg

SEQ ID NO: 341049 - DNA, 454 bp, Homo sapiens
  misc_feature: GZ8MTXP02H71CW.9.14.B03.1.454.CMB.2.raw
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (439)..(454): a, c, t, g, unknown or other
  misc_feature (439)..(454): n is a, c, g, or t
tcagtgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacacctgcgagccgaggacacggccgtatattactgtgcgaagaactaacccgttcgccttggttattaccttgacacgttggggccagggaaccctggtcaccgtctcctcacgccctccaccgaagggccccatccggtccttccccctggccgcccctgctccgaggcnccaccgtccgagancacaggccggcccgtgggctcgcctggtacaacggtactaccttccagtacgtatcgacgtgacgcggggtctggggacaagggccacagtacgnnnnnnnnnnnnnnnn

SEQ ID NO: 341050 - DNA, 515 bp, Homo sapiens
  misc_feature: GZ8MTXP01BWAFA.15.56.F01.1.454.CMB.2.raw
  modified_base (476)..(476): a, c, t, g, unknown or other
  misc_feature (476)..(476): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctcaggggtttctaatcgcttctctggctccaagtctgacaacaccggcctcctgacaatctctgggctccaggctgaggacgagggtgattattactgctgcgcatatagaagtcccatcgtttggtacttttcggcggtagggaccaagctgaccgtctaggtcagcccaaggcttgccccttggtcncttcttcgttcccaaccctctcgctacgttagcttgcgg

SEQ ID NO: 341051 - DNA, 516 bp, Homo sapiens
  misc_feature: GZ8MTXP01DTYGJ.15.56.F01.1.454.CMB.2.raw
  modified_base (394)..(394): a, c, t, g, unknown or other
  misc_feature (394)..(394): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctcgagggtttcaatcgcttctctggctccaagtctagacaacaccggcctcctgacaatctctgggctccaggctgaggacgagggtgattatactgctgcgcatanagaacgtcccattgttggttacgttttcgggcggtagggacaagctgaccgtctaggtcacgcccaaggcttcgccccttggtccacttcgttgttcctcaccctctcgcttacgtgcgtgg

SEQ ID NO: 341052 - DNA, 528 bp, Homo sapiens
  misc_feature: GZ8MTXP01CFJWU.15.56.F01.1.454.CMB.2.raw
  modified_base (269)..(269): a, c, t, g, unknown or other
  misc_feature (269)..(269): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctggtaccaacatcacccaggcaaacgcccccaaatcatgattangagacaatgagcggcctgagggtttctaatcgcttctctggctccaagtctgacaacaccggcctcctgacaatctctggctcaggctgaggacgagggtgattatactgctgcgcatataagaagtcccattgttggttacgttttcggcggagggaccaagcgtgaccgtctaggtcacgcccaaggccttcgcccccgttggtcctacttccgttcgttccccgtccctcctcgcctacgttgaaccgttgaacgg

SEQ ID NO: 341053 - DNA, 617 bp, Homo sapiens
  misc_feature: GZ8MTXP01CJSEW.15.56.F01.1.454.CMB.2.raw
  modified_base (391)..(391): a, c, t, g, unknown or other
  misc_feature (391)..(391): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgctccgtgtctggtctcctggacagtcgatcaccatctcctgcactggaaccagcagtgatgttggacttacaacttgtctctggtacaacatcaccagacaacgccccaaatcatgattatgaagacaatgagcggcctcgagggttcaactcgcttcgtcgtggctcgaagtctagaaccaacgaccccgtacctacctagaactaactctacgtcgggcctacccgagggctaggacggaggaagggtntaattactagtgactggacataatagtacgaactacccattaggtttacggttacgttttcggggacggaaggaacccgaaagtcgtacggaaacccgtcgttacgggtcaaccggccgaaacgggtcttcccggtaaccccgttcggtaaaccctacgttcccttacggttacccccctaacccggttctccggtaccgttaccggaagttcccggttgggaacg

SEQ ID NO: 341054 - DNA, 555 bp, Homo sapiens
  misc_feature: GZ8MTXP01BW9A5.15.56.F01.1.454.CMB.2.raw
  modified_base (347)..(347): a, c, t, g, unknown or other
  misc_feature (347)..(347): n is a, c, g, or t
  modified_base (553)..(553): a, c, t, g, unknown or other
  misc_feature (553)..(553): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcgagggtttcaatcgcttctctggctccaagtctgacacaccggcctcctgacatcnctggctccaggctgagacgaggtgattatactgcttgcgcgatagtacgaagttcccactgtttacggtcgttttagggcggagggacccagaccgtggtacccgtccgtcgggtacacgcccggaacggcttccggtcccccttcgggtaacctcttcccgttgtttccccgcccctccttcgaaccgtcgttagaacgttcggngg

SEQ ID NO: 341055 - DNA, 522 bp, Homo sapiens
  misc_feature: GZ8MTXP01DZ62Z.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaactcatgattatgagacaatgagcgcctgagggtttcaatcgcttctctggctcagtctgacacaccgcctcctgacaatctctgggctccgaggctgagggacgagggtgattatactgctgcgcatatagaacgtcccacttgttggttacgttttcggcggtagggaccaagctgaccgtcgtagtcacgcccaaggcttcgccccttgtctacttcgttcgttcccaaccctcctcgctacgttacgtaacgttgaacgg

SEQ ID NO: 341056 - DNA, 540 bp, Homo sapiens
  misc_feature: GZ8MTXP01DEE6L.15.56.F01.1.454.CMB.2.raw
  modified_base (269)..(269): a, c, t, g, unknown or other
  misc_feature (269)..(269): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaatcatgattangaggacaatgagcgcctcgagggtttcaatcgtcttctctgctcaagtctagacaacacccggcctctgacaatctctgggctcgaggctgaggacgagggtgtattatactgctgacgctatatagaacgtccattgtttaggttacgttttcgggcggtacggaccgaagcgtacgtaccgtccgtaggtcacgcccgaagcgttaccgccccttcggtcctcttccgttcgttccccgccctcctcgtctacgttagtcgttggcggg

SEQ ID NO: 341057 - DNA, 529 bp, Homo sapiens
  misc_feature: GZ8MTXP01BQSYH.15.56.F01.1.454.CMB.2.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (334)..(334): a, c, t, g, unknown or other
  misc_feature (334)..(334): n is a, c, g, or t
  modified_base (371)..(371): a, c, t, g, unknown or other
  misc_feature (371)..(371): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaacttgtctctgtacaanatcaccagcaaagcccccaaatcangattatgagacaatgagcggccctgaggggtttctaatcgcttctctggctccaagtctgacaacacccggcctccngacaatctctgggctccgaggctgagggacgagggtnattattactgctgcgctaatataagaacgtcccaattgtttggttacgttttcggggacggagggtaccaagctcgaccgtctaggtcacgcccaaggcttcgccccttcggtcacttcttcgttccccaacctcctcgctacgttacgtcgttgcgg

SEQ ID NO: 341058 - DNA, 515 bp, Homo sapiens
  misc_feature: GZ8MTXP01DX4IC.15.56.F01.1.454.CMB.2.raw
  modified_base (292)..(292): a, c, t, g, unknown or other
  misc_feature (292)..(292): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaaatgagcggccctnaggggtttcaatcgcttctctggctccaagtctgacaacacggcctcctgacaatctctgggctccgagctgagacgagggtgattattactgctgcgcatatagagtcccatgttgtacttttcgggcgtagggaccaagctgtaaccgtctaggtcagcccaaggcttcgccccttcggtcacttcttcgttcccaaccctctccgctacagtcgttgcgg

SEQ ID NO: 341059 - DNA, 549 bp, Homo sapiens
  misc_feature: GZ8MTXP01ETFTW.15.56.F01.1.454.CMB.2.raw
  modified_base (348)..(348): a, c, t, g, unknown or other
  misc_feature (348)..(348): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctctggtaccaacatcacccaggcaaacgcccccaaactcatgatttatgaggacaaatgagcgccctgagggtttctaatcgcttctctggctccaagtctgacacaccggcctctgacatctcnggctcgaggctgagggacgagggtgtattattactgctgcgctatataagacgtccctacgttgttcgggttacgttttcggggacggtacgggtaccgaagcgtcgtaccgtccgtaggtccacgcccaaggccttcgccccgttcggtccacttcgttcgttcccgccctccgtcgctacgttacgtaacgttgaacgg

SEQ ID NO: 341060 - DNA, 551 bp, Homo sapiens
  misc_feature: GZ8MTXP01CDE6X.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaatcatgatttatgaggacaaatgagcggccctgaggggtttctaatcgcttctctggctccaagtctgacaacacccggcctcctgacatctctgggctccgaggctggagggacgagggtgtattatactgctgcgctatatagaacgtcctacttgtttcggttacgtttcgggcggtacgggaccaagctgtaccgtcgtaggtcacgcccgaaggcttccgccccgttcggtcctcttccgttcgttccccgccctccgtcgtccgtacgttacgtaacgttggcggg

SEQ ID NO: 341061 - DNA, 526 bp, Homo sapiens
  misc_feature: GZ8MTXP01A4C9G.15.56.F01.1.454.CMB.2.raw
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaactcatgatttatgaggacaaatgagccggccctcgaggggtttctaatcgcttctctggctccaagtctgacaacaccggcctcctgacaatctctgggctccaggctgaggacgagggtgattatacngctgcgcatanagacgtcccatcgttggtacttttcggcggagggaccaagcgtgaccgtcgtaggtcacgccaaggcttcgccccttcggtcacttcttcgttcccaaccctctcgctacgttagaacttgaacgg

SEQ ID NO: 341062 - DNA, 533 bp, Homo sapiens
  misc_feature: GZ8MTXP01DNVUX.15.56.F01.1.454.CMB.2.raw
  modified_base (263)..(263): a, c, t, g, unknown or other
  misc_feature (263)..(263): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcangattatgagacaatgagcggccctgaggggtttctaatcgcttctctggctccaagtctgacaacaccgcctcctgacatctctggctcgagctgaggacgaggtgattagtactgctgcganatanagacgtcctagtgttggttacgttcgggacggaggacagcgtcgtaccgtcgtacgcacgccgaagccttccgccccgttcgtcctacttccgttccgttccccgcccttccgtccgtctacgttacgtaacgttcggaacgg

SEQ ID NO: 341063 - DNA, 621 bp, Homo sapiens
  misc_feature: GZ8MTXP01DOC8T.15.56.F01.1.454.CMB.2.raw
  modified_base (424)..(424): a, c, t, g, unknown or other
  misc_feature (424)..(424): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgatttatgagacaaatgagcggccctcaggggtttctaatcgcttccctgtcgtcctacgtacttcgacgaacaaccgaccccgtcccttccgacgaactacttccttcggcggtccctacggacgtcgagggacgagggtagggtattattactagtcgngtcggacatataagaagtacctacctagttgttacgggtttacggtttcgggacggggtaacgaacgaacgtcgtaccgtacccgtacggttcgacgaccgaacggaacgtcgttccccgtccccggttcgtcctccttcgttccccggttcccccctcccgttccgtccgtacgtacgttacgtaacgcggtcggg

SEQ ID NO: 341064 - DNA, 599 bp, Homo sapiens
  misc_feature: GZ8MTXP01A0PMA.15.56.F01.1.454.CMB.2.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtaccaacatcaccagcaaacgccccaaatcatgattangagacaatgagcgcctgtagggtttctaatcgcttctctggctacaagtctagacaacgaccgcctccngacatctcgtggctcgagctgaggacgaggtntattatacngctgcgactaatataacgaacgtcccgtaattggtttacgggttaacgtttcggggaccggaacgggtacccaaagtcgtacggtacccgttcgtacggttaccgacgaccccgtaaagggtcccttccgtccccccgttcgggtacctacccgttcccttccggttacccccctaacccgttcccgtcgtccgtaaccggttacgtaaccgttcggaaccgggg

SEQ ID NO: 341065 - DNA, 525 bp, Homo sapiens
  misc_feature: GZ8MTXP01BLDQ9.15.56.F01.1.454.CMB.2.raw
  modified_base (479)..(479): a, c, t, g, unknown or other
  misc_feature (479)..(479): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaatcatgattatgagacaatgagcggccctgagggtttctaatcgcttctctgctccaagtctgacaacaccgcctcctgacaatctctgggctccgaggctggaggacgagggtgtattattactgctgcgcatatagaacgtcctatgtttggttacgttttcggcggtagggaccaagctgaccgtcgtaggtcacgccaagcttcgccccttcggtcncttcgttcgttcccaaccctcctcgctacgttagaacgttgaacgg

SEQ ID NO: 341066 - DNA, 563 bp, Homo sapiens
  misc_feature: GZ8MTXP01A7R92.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgatttatgaaggacaaatgagcggcccctcgaggggtttcaatcgcttctctggctccaagtctgacacaccggcctctgacatctctgggctcaggctggaggacgagggtgtattatactgctgcgctatatagaacgtcccaacgttgtttgggttaacgtttttcggggcggtacgggaccgaaagcgtcgaccgttccgtaggtcgacgcccaaaggccttcgcccccgttggtcctacttccgttcgttccccgtccccgtccgtccgtccttacgttacgtcgttggaacggg

SEQ ID NO: 341067 - DNA, 542 bp, Homo sapiens
  misc_feature: GZ8MTXP01D1VXR.15.56.F01.1.454.CMB.2.raw
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (541)..(541): a, c, t, g, unknown or other
  misc_feature (541)..(541): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaactcatgatttatgaaggacaaatgagcggcccctcaggggtttctaaatcgcttctctggctccaaagtctgacaacaccggcctcctgacaatcnctggggctccaggctgaggacgagggtgattatactgctncganananagactaccactgttggttacgtttcggtcgggacggacgaagacgtcgaccgtccgtacgtacgacgccgaacgcgttcgtccccgttccgtcctacttcgttcgttccctccctcctcgctacgttacgtaacgttgng

SEQ ID NO: 341068 - DNA, 545 bp, Homo sapiens
  misc_feature: GZ8MTXP01DP8G7.15.56.F01.1.454.CMB.2.raw
  modified_base (406)..(406): a, c, t, g, unknown or other
  misc_feature (406)..(406): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaatcatgatttatgaaggacaaatgagcggccctgaggggtttctaatcgcttctctggctccaagtctgacaacaccggcctcctgacaatctctgggctccgaggctaggagggacgagggtgtattattactgctgacgcaatanagaacgtccaattgttagggttaacgttttcgggacggtagggaccgaagctggaacccgtcgtaggtcacgccaaggcttcgccccttcggtcacttcttcgttccccaaccctctcgctacgttgaacgttgaacgg

SEQ ID NO: 341069 - DNA, 522 bp, Homo sapiens
  misc_feature: GZ8MTXP01AXND7.15.56.F01.1.454.CMB.2.raw
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgattatgagacaatgagcggccctcgagggtttcaatcgcttctctggctcaagtctgacaacaccgcctcctgacatcnctggctcaggctgaggacgagggtnattatactgctgcgcatatagaacgtcccagttgttggttacgtttcgggcggtagggaccaagcgttgaccgtctaggtcacgccgaaggcttcgcccccttggtccacttcgttcgttccccgcccttccgtcgctacgttagcgttgcgg

SEQ ID NO: 341070 - DNA, 575 bp, Homo sapiens
  misc_feature: GZ8MTXP01AXQBY.15.56.F01.1.454.CMB.2.raw
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtaccaantcaccagcaagccccaaatcangattangagacaatgagcgcctgtagggtttcaatcgtcttctctggctcagtctgacaacaccgcctcctgacatctcnggctcgagctggaggacgaggtntattatactgctgcgcatanagtaactcccattgttcggttacgtttcggggacggtacgggaccaaggtccgtacgacccgttccgtaggtccacggccccgtaaagggtcccttccggtccccccttcgggtccctaaccttcccgttccggttcccccggtccccttcccgttccgtcccgttaaccggttacgtaaccgttcggtaaccgggg

SEQ ID NO: 341071 - DNA, 534 bp, Homo sapiens
  misc_feature: GZ8MTXP01D68BN.15.56.F01.1.454.CMB.2.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (517)..(517): a, c, t, g, unknown or other
  misc_feature (517)..(517): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctggtacaacatcacccaggcaaacgccccaaactcatgatttatgaggacaatgagcggcctgtagggtttctaatcgcttctctggctccaagttctagacaacaccggccctcctagactaactctctgggctccgaggctggaggacgagggtntattattacngctgcgctatatagactccagttgttcggttacgtttcgggacggtaggacaagctagaccgtcgtagtcacgcccgaagccttcgccccgttgtctacttcgttcgttcctcctaccctcctcncttacgtcgaacgtcgg

SEQ ID NO: 341072 - DNA, 608 bp, Homo sapiens
  misc_feature: GZ8MTXP01EYJQH.15.56.F01.1.454.CMB.2.raw
  modified_base (268)..(268): a, c, t, g, unknown or other
  misc_feature (268)..(268): n is a, c, g, or t
  modified_base (394)..(394): a, c, t, g, unknown or other
  misc_feature (394)..(394): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctggtctcctggacagtcgatcacatctcctgcactggaaccagcagtgatgttgggacttacaacttgtctcctggtaccaacatcacccaggcaaacgcccccaaatcatgatttangagacaatgagcgcctgtagggtttcaatcgcttctcgtcggctccgaagtctagaacaacgacccgcctctagaacactctcgtggcctccgaggctaggacgggacgtagggtagtattatacngctgacgatatagtaagacgtccctaagttcgtttacgggttacgttttcggggacggtaacggaacccgaagccgttacggacccgttcgtaaacgggtccacggaccccgaaggtccgttccgcccccgtttggacccgtaacttccgttccggttacccctccccggtccttccggaccgttaccggttacgtaaccgttcgggaaccggg

SEQ ID NO: 341073 - DNA, 552 bp, Homo sapiens
  misc_feature: GZ8MTXP01A8PLV.15.56.F01.1.454.CMB.2.raw
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtacantcaccagcaagccccaaatcatgattatgagacaatgagcggccctgagggtttctaatcgcttctctgctcagtctgacacaccgcctcngacatctctggctcgagctaggaggacgaggtgtattatactgctgacgactatagtagactcccagttcgttaggttacgttttcggggacgggtacggaaccgtaagtccgtaggtacccgtaccgtacggtaccacgcccgaacggtccgttccgtcccccgttcggtacctaccgttcgttcccgttccccaaccctccctcgtcgtacgttcgaacgttgaaccggg

SEQ ID NO: 341074 - DNA, 561 bp, Homo sapiens
  misc_feature: GZ8MTXP01DAZY1.15.56.F01.1.454.CMB.2.raw
  modified_base (235)..(235): a, c, t, g, unknown or other
  misc_feature (235)..(235): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctgtaccaantcaccagcaaacgcccccaaactcatgattatgaggacaatgagcggcctcgagggtttctaatcgtcttctctggctccaagtctgacaacacccggcctctgacaatctcgtggctccgaggctggacgggacgagggtgtaattatactgcttagcgactatagtaagaacgtccctaagttgtttgggttaacgttttcggggacgggtaacgggaccaaagcgtacgaccgtcctaggtcacgcccaaggcttcggccccttcggtccacttccgttcgttcccgtccctcctcgcctacgttacgtaacgttggaacggg

SEQ ID NO: 341075 - DNA, 537 bp, Homo sapiens
  misc_feature: GZ8MTXP01DB10S.15.56.F01.1.454.CMB.2.raw
  modified_base (266)..(266): a, c, t, g, unknown or other
  misc_feature (266)..(266): n is a, c, g, or t
  modified_base (370)..(370): a, c, t, g, unknown or other
  misc_feature (370)..(370): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccaacatcacccaggcaaacgccccaaatcatgattangagacaatgagcgccctgagggtttctaatcgcttctctggctccaagtctagacaacacccggcctctagacaatctctggctcaggctgagggacgagggtntattatactgctgcgcatatagaacgtcccagttgttggttacgttttcggacggtacgggacaagcgtcgaccgcctaggtcacgcccgaaggccttcgccccttcggtctaccttcgttcgttccccgccctcctaacgtcctacgttacgtaacgttcgaacgg

SEQ ID NO: 341076 - DNA, 529 bp, Homo sapiens
  misc_feature: GZ8MTXP01AKQ6R.15.56.F01.1.454.CMB.2.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggacttacaccttgtctctgtaccaantcaccagcaaacgccccaaatcatgattatgagacaatgagcggccctcgtagggtttctaagtcgtcttctctggctcaagtctgacacaccgcctccngacaatctcgtgggcctcgaggctggagggacgtagggtntattattacgtgctgcgactatatagaactcctattgttcggttacgtttcgggacggacgggaccaagcgtacgaccgtctagtcacgccgaaggcttcgccccttcggtcncgttccgttcttcccnccctctccgctacgacgcgttcggcgg

SEQ ID NO: 341077 - DNA, 626 bp, Homo sapiens
  misc_feature: GZ8MTXP01C1PGY.15.56.F01.1.454.CMB.2.raw
  modified_base (269)..(269): a, c, t, g, unknown or other
  misc_feature (269)..(269): n is a, c, g, or t
  modified_base (341)..(341): a, c, t, g, unknown or other
  misc_feature (341)..(341): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctctggtaccaacatcacccaggcaaacgccccaaatcatgatttangaaggacaaatgagccggcctcgtaggggtttcaatcgcttctctggctcaagtctgacaacaccgcctccngacatctctggctcgaggctggagacgagggtgtattattactgctgacgctataatagaaacgtccctacgttcggtttcggttaacgtttttcggggacgggtaacgggaccgtaagccgttacggtaacccggttcctaacgggttaccgacggaccccgtaaacgggtcccgttcccggtcccccgttccgggttccgtcccttcccgttccgttcccccggtccccttccccgttcccggtaccgttaaccggttacggtaaccgttcggtaacccgggg

SEQ ID NO: 341078 - DNA, 557 bp, Homo sapiens
  misc_feature: GZ8MTXP01BDYM3.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggacaaacgcccccaaactcatgattatgagacaatgagcggccctgagggtttctaatcgcttctcgtgctccagtctgacacaccggcctctgacatctcgtggctccaggctggaggacgagggtgtattattacgtcgctgcgactatatagaacgtcctacgttgttgggttacgtttcgggacgggtacggaccaagctcggaccgtcctaggtcacgcccgaacgtccgttcgcccccgttcggtcctaccttccgttcgttcccccgtccctcccgtcgctacggttacgtaacgttcggtcggg

SEQ ID NO: 341079 - DNA, 563 bp, Homo sapiens
  misc_feature: GZ8MTXP01BE0K5.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaacttgtctctggtaccaacatcacccaggcaaacgcccccaaactcatgattatgaggacaatgagcggccctcgaggggtttctaatcgtcttctctggctcaagtctgacaacacccggcctcctgacatctctgggcctccgaggctggaggacgagggtgattagttactgtctgcgactatatagacgtccctagttcggttggttacgttttcgggcgggacgggaccgaagcgtcgtaccgtccgtacgggtcacgcccgaaggccgttcgcccccgttccgtcctaccgttccttccgttcccctaacccctccctccgtctacgacgtaacgttgcggg

SEQ ID NO: 341080 - DNA, 641 bp, Homo sapiens
  misc_feature: GZ8MTXP01BK4E1.15.56.F01.1.454.CMB.2.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagtctacgtagccacgaccggtgctcgatttagcagacgtctgtcgggacgtctccaccatggcctgggctctgctgctcctcaatctcctcactcaggacacagggtcctgggcccagtctgccctgactcagcctgcctccgtgtctgggtctcctggacagtcgatcaccatctcctgcactggaaccagcagtgatgttggacttacaccttgtctctgtaccaacntcacccagcaaacgccccaaatcangattatgagacaatgagcggccctgtagggtttctaatcgtcttctcgtcggctaccgaagttcctaggaaccaaccgaccccggtccctccgtagactaacgtcctcgtcggggcccttaccgagggtccgtagggacgggtacgggtagggtagtatttattacgtgccgtgaccgatataagtacgtaacgtccctaagttcggtttcgggttaacgttttcggggacgggtacggaactaagtcgtacgtaaccgtccgttaaggtccacgacccgaacggtccgttcccggtcccccgttcgggtaccctacgttcccgttccgttccccctaacccttcccgtccgtaccgtacgttacgtcgttaacgggtccggg

SEQ ID NO: 341081 - DNA, 547 bp, Homo sapiens
  misc_feature: GZ8MTXP01ENQOS.15.56.F01.1.454.CMB.2.raw
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgatttatgagacaatgagcggccctgaggggtttctaatcgcttctctggctccaagtctgacaacaccggcctcctgacaatcnctgggctccaggctggaggacgagggtgattatacngctgcgctatatagaacgtccctacttgtttggttacgttttcgggcgggtacgggaccaagctgaccgtctaggtcacgcccaaggtcgttcgcccccgttggtccacttccgttcgttccccgccccttccctcgcctacggttacgtaacgttgaacggg

SEQ ID NO: 341082 - DNA, 624 bp, Homo sapiens
  misc_feature: GZ8MTXP01DVKJE.15.56.F01.1.454.CMB.2.raw
  modified_base (349)..(349): a, c, t, g, unknown or other
  misc_feature (349)..(349): n is a, c, g, or t
  modified_base (401)..(401): a, c, t, g, unknown or other
  misc_feature (401)..(401): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccaacatcacccagacaaacgcccccaaatcatgtattatgaaggacaatgagcggccctgtaggggtttctaatcgtcttctctcggctccaagtctagacacaccgcctctgacatctcgnggctcgaggctggaggacggagggtgtactttatacgtgctgacgctaatanagaacgtcctacgttggtttacggttaccggttttcggggacgggtaacgggaaccgtaaacgtcgtacggtaacccggttccgtaacgggtaccgacggtccccgaaacgggtcccgttccggtccccccgttcgggttaccctaccgttcccgttcccggttccccctaaccccgttacccgtccgtacccgtaccggttacgtccggttcgggaaccggg

SEQ ID NO: 341083 - DNA, 598 bp, Homo sapiens
  misc_feature: GZ8MTXP01EPDRG.15.56.F01.1.454.CMB.2.raw
  modified_base (231)..(231): a, c, t, g, unknown or other
  misc_feature (231)..(231): n is a, c, g, or t
  modified_base (374)..(374): a, c, t, g, unknown or other
  misc_feature (374)..(374): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccaanatcaccagcaaacgccccaaatcatgattatgaaggacaatgacgcggccctcgtagggtttctaatcgtcttctcgtggctccaagttctagacaacacccggcctcctgacatctctgggctcgagctgacggacgaggtntattatactgctgcgactatatacgtaacgtcctacgttgttacggttacgttttcggggacgggtacgggaaccgaagtccgtacgtacccggtccgtaacggtaccacggccccgaaacgggtcccgttccggtcccccgttcggtccctaccgttccgttccgtttacccccgtaaccccttcccgtccgtaccgtacgttacgtaaccgttggaaccggg

SEQ ID NO: 341084 - DNA, 567 bp, Homo sapiens
  misc_feature: GZ8MTXP01DOKM5.15.56.F01.1.454.CMB.2.raw
  modified_base (353)..(353): a, c, t, g, unknown or other
  misc_feature (353)..(353): n is a, c, g, or t
  modified_base (384)..(384): a, c, t, g, unknown or other
  misc_feature (384)..(384): n is a, c, g, or t
tcagtctacgtagccacgaccggtgctcgatttagcagacgtctgtcgggaagtctccaccatggcctgggctctgctgctcctcactctcctcactcaggacacagggtcctgggccccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaaggacaaatgagcggccctcgagggtttctaatcgcttctctggctccaagtctgacacacggcctcctgacaatctcnggctccagctgaggacgaggtgattattacngctgcgcatatagaacgtcccagttcgttggttacgttttcgggcggtacgggtaccaagcgtgaaccgtctaggtcacgcccgaaggtccttcgccccccgttggtaccctccttaccgttccggttcccccaaccccttcccgtccgtccgtaccggttacgtaaccgttcgggaaccggg

SEQ ID NO: 341085 - DNA, 546 bp, Homo sapiens
  misc_feature: GZ8MTXP01ETR0F.15.56.F01.1.454.CMB.2.raw
  modified_base (343)..(343): a, c, t, g, unknown or other
  misc_feature (343)..(343): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctctggtaccacatcacccaggcaaacgcccccaaactcatgatttatgaggacaatgagcggccctgaggggtttctaatcgcttctctggctcagtctgacacaccgctcctgacatcnctggctccagctgaggacgagggtgattatacgtgctgcgctagtatagaacgtccctacgttgtttcggttacgtttttcgggcggtacgggaccaaagcgtacgaccgtccgtagtacacgccaaggtccgttcgccccgttcggtccacttcgttcgttccccaaccctcccgtcgcgtacgttacgtccttggaacggg

SEQ ID NO: 341086 - DNA, 518 bp, Homo sapiens
  misc_feature: GZ8MTXP01CP91C.15.56.F01.1.454.CMB.2.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaaatcatgatttatgaggacaaatgancggccctnaggggtttcaatcgcttctctggctccaagtctgacaacacccggcctcctgacaatctctgggctccaggctgaggacgagggtgtatattactgctgcgcatatagaatcccatgttggtactttggcgagggaccaagctgaccgtctaggtcagcccaaggcttggccccttggtccacttcttcgttcccaacctcctcgctacgttagaaccttgaacgg

SEQ ID NO: 341087 - DNA, 535 bp, Homo sapiens
  misc_feature: GZ8MTXP01EI9L0.15.56.F01.1.454.CMB.2.raw
  modified_base (297)..(297): a, c, t, g, unknown or other
  misc_feature (297)..(297): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (515)..(515): a, c, t, g, unknown or other
  misc_feature (515)..(515): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccaacatcacccagcaaagccccaaatcatgattatgagacaaatgagcgcctgagggtttctaatcgnttctctggctccaagtctgacaacaccggcctcctgacaatctctgggctccgaggctggaggacgaggtgattatactgactgcgnatanagaacgtccctaattgttggttacgttttcgggacgggtaagggaacccaagcgttagacccgttcgtaggtcacgcccgaaaggccttcgcccccttggcacttcgttcgttccccgcctccgtcnctagagtaacgttgaacggg

SEQ ID NO: 341088 - DNA, 615 bp, Homo sapiens
  misc_feature: GZ8MTXP01A8QBE.15.56.F01.1.454.CMB.2.raw
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
  modified_base (421)..(421): a, c, t, g, unknown or other
  misc_feature (421)..(421): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagaagtgatgttggacttacaaccttgtctctgtacaacntcaccagcaaagccccaaatcatgatttangaggacaatgacgcggtccctcgtagggggtttcctaaattcgctttctcgttagggcctttacccaaagttctacggacaaacgccgggtccccctaccccgtagacctaaatcccttcgcgggctcccgaagggcctggaacgggcgtaggggttntattactacgtcgcgtgcgtactaattaagtacgtaacgtccctagttcgtttacggttacggtttacggggacgggacgggaacctacggccgtacggtacccgtacgtggtccaacgccgtaacggtctccgccccgttacgcctacgttcttccgttcccgccctccgtacgcgtacgtacgcgtgcgcgg

SEQ ID NO: 341089 - DNA, 621 bp, Homo sapiens
  misc_feature: GZ8MTXP01DD14W.15.56.F01.1.454.CMB.2.raw
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtacaanatcacccaggacaaacgccccaaatcatgattangagacaatgagcgcctgtagggtttcaatcgtacttctcgtggcctaccgaagttccagaaccaacgaccccggccctccgtagaacctaactcttcgtcgggctccgaagggctaggaacgggtacggaagggttagtaatttacttaacgtcgccgttgaccgtactaataacgtacgaacgtcccctaagttcgtttacggttacgtttcgggacgggtaacggacctaacgcgtacgaccggtacttaggaccacggaccgaacggtcttccgtccccgttacggtcctacttccggttaccttccccctaaccgtcctcggtcctaccggttagaaccgttggaaccggg

SEQ ID NO: 341090 - DNA, 587 bp, Homo sapiens
  misc_feature: GZ8MTXP01DJTVB.15.56.F01.1.454.CMB.2.raw
  modified_base (322)..(322): a, c, t, g, unknown or other
  misc_feature (322)..(322): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgtctctgtaccaacatcacccaggcaaacgccccaaatcatgattatgaagacaatgagcgccctcgtagggtttctaatcgcttctctgctcagtctgacacnccgcctcctgacactcctctcgggctccgaggtctaggaggacggtagggtagtattagttacgtgctcgcgtacataagtagtaacgtccctaagttcgtttgggttacgttttcggggacggtaacgggaaccgaacgtcgtacgtaaccgttccgtaagggtccacgcccgaaacggtccgttccgcccccgttcggtacctaccttccgttccgttaccccaacccgttcctccgtcctacgttacgtaacgttcggcggg

SEQ ID NO: 341091 - DNA, 604 bp, Homo sapiens
  misc_feature: GZ8MTXP01D8HU2.15.56.F01.1.454.CMB.2.raw
  modified_base (234)..(234): a, c, t, g, unknown or other
  misc_feature (234)..(234): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccaacntcacccagacaaacgccccaaatcatgattatgaagacaatgagcggccctgtagggtttctaatcgcttctcgtcggctccgagtctagactaaccgaccggccctacctgaacaatcctcgtgggcctccgaaggctaggagggacgtagggtagtattaattacgtgtccgtgcgtactagtaatacgaacgtcctacgttgtttcgggttacgttttcgggacgggacggtaccgaagtcgtcggacccgttccgtaggtccacggcccgaacgggtccttcccgcccccgttcgtaccgtccgttccgttccgttcccccgtccccgtccgtccgtcgtacggttacgtccgttggtaaccgggg

SEQ ID NO: 341092 - DNA, 631 bp, Homo sapiens
  misc_feature: GZ8MTXP01C0Z2E.15.56.F01.1.454.CMB.2.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (248)..(249): a, c, t, g, unknown or other
  misc_feature (248)..(249): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgtctctgtaccantcaccancacacaccannatntatnagaganagngcgccgtccgtaggttacggttactacgtcgtcttctcgtcgcctacgtagtctacgaaccacccgccgtcctcgtataactaactcgtcgcgtccgtacgacggngagggagggacggtagttattaattacgtacngtcgtagcctaataattaagaacgtccgtaccgttagtttcggtttacggtttacgggtaccgggagggtaaccgactacggtcgtaaccggtacccgttacgtacgaccgacccggaaccgtcggttccccgtccccggttaccccgtttgaccccgttcccgttccgttccccgtaaccccctaccccgtcgttacccgtcgttaacgtaaccgttcggtaacggg

SEQ ID NO: 341093 - DNA, 677 bp, Homo sapiens
  misc_feature: GZ8MTXP01BD3UG.15.56.F01.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgacantcaccagcaacgccccaatcatnattangagacatgngcgcctgtaggtttcatcgcttctctggctccagtctacgaactaccgacccggccctcctagacctaactcctacgtcgggtcctaccgagggtcctagggaacgggtacgggtagggttagtaactttaagtttacccgtgtccgttaggacccggtactaattacgtaacggaaaccgttccccgtaagtttcgggtttacggggtttaacgggtttttccggggaaccgggttaacggggaaccgtaaacggtccgtaccggtaacccggttccggtagggtaccctaccggaccccgaacggtccgttcccggtcccccgttcgggtaccctccgttcccgttcccggttaccccctccccgttcccgtcccgtaccgttaccgttaacggtcgttcgggcccgggg

SEQ ID NO: 341094 - DNA, 660 bp, Homo sapiens
  misc_feature: GZ8MTXP01AS4JU.15.56.F01.1.454.CMB.2.raw
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgacaacntcaccagcaacgccccaatcatgtattangagacatgagcgcctgtagggtttctaatcgtcttctctggctaccaagtctagaaccgacacccggccctccgagactaactcctcgtcgggcctcgaggcgtaggaagggacggtaagggttgtattagttacgtgcgttgacgtactaagtaacgtacggtaaccgttcctacgtttaggtttacggggtttacggttttacgggggaccgggtacgggtaaacccgtaaacgtccgttacggtaccccggtccgtaacgggtacctacgggaccccgaacgggtcccgttcccggtcccccgttccggtcctacccgttcccgttccccggttcccccgtccccgttcccgttaaccggtcccttaccgggttacgtccggttaacgggtcccgggg

SEQ ID NO: 341095 - DNA, 610 bp, Homo sapiens
  misc_feature: GZ8MTXP01AQONE.15.56.F01.1.454.CMB.2.raw
  modified_base (557)..(557): a, c, t, g, unknown or other
  misc_feature (557)..(557): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctgtaccaacatcacccaggcaaacgcccccaaatcatgattatgaggacaatgagcgccctgagggtttctaatcgcttctctggctccaagtctgacaacacccggcctcctgacaatctcgtgggcctccgaggcccgaggacgagggtgtattattacgtgcgtgcgacagttagtagaacgtccctaacgttgtttcgttaacgggttttcgggacgggtacgggaacctaagccgtacgacccggttaccgtacggtccacggaccccgaagggtccctccggcccccgttcgggttccctaacccgttccgttccgtttacccccnccccgttccctccgaaccgttaacggttacgacccgttggaacggtcccgggg

SEQ ID NO: 341096 - DNA, 603 bp, Homo sapiens
  misc_feature: GZ8MTXP01D64EO.15.56.F01.1.454.CMB.2.raw
  modified_base (236)..(236): a, c, t, g, unknown or other
  misc_feature (236)..(236): n is a, c, g, or t
  modified_base (331)..(331): a, c, t, g, unknown or other
  misc_feature (331)..(331): n is a, c, g, or t
  modified_base (390)..(390): a, c, t, g, unknown or other
  misc_feature (390)..(390): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctggtaccaacntcacccaggcaaacgcccccaaactcatgattatgaggacaatgagcggccctcgtagggtttctaatcgcttctctggctcagtctagacaacnccgcctcctgacaatctctcgggctccgaggctaggagggacgagggtgtattattacngtcgtgcgacagtaatacgaaacgtccctaagttcggtttacgttacggttttcggggacgggaacgggacctaagccgtcggtacccgtccgtaggtaccgacgcccgaaacggtccttccggtcccccttcggtacctacccgttccgttccgttccccctaaccccttcctaaccgtccgttaacgttacgtaaccgttcggaaccgggg

SEQ ID NO: 341097 - DNA, 720 bp, Homo sapiens
  misc_feature: GZ8MTXP01A4RNS.15.56.F01.1.454.CMB.2.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtacantcaccagcaaacgccccaaatcatgattanagagacatgacgcgcctagtaggtttactatcgtcttcgtctcggtcctacgtaagttcctacggaaccaaccgtaacccccggtccccttaccgtacggaaccctaacgttacccgttcggtttccggggaccctacccggtaacggggtaccggtacggggaacgggggtaaccgggttaagggggttagtaaagtttttaaccgttaccgtcgggtaccttacggacggtaactacttaagtaaaccggtaccgttaaccccgttagtttcgtttacgggggttttacggtttacggggacgggtacgggaccgaacgtcgtacggtaccgtacgtacggtccgaaccgtccgaacggtcccttacccggtcccccttcggtacctaccgttccgttcccgttacccctaaccccttccgtaaccgtccctacggttacgtaacgttcggtaaccggg

SEQ ID NO: 341098 - DNA, 593 bp, Homo sapiens
  misc_feature: GZ8MTXP01AUQXB.15.56.F01.1.454.CMB.2.raw
  modified_base (238)..(238): a, c, t, g, unknown or other
  misc_feature (238)..(238): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaaccaacntcacccaggacaaacgccccaaatcatgattatgagacaatgagcgcctgtagggtttctaatcgcttctctggctcaagtctagacacacccgcctcctgacatctctggctccgagctgacggacgtagggtntattattcgngtctgcgatatagtacgtacgtcctagttcgttacggttacggttacgggacggtaacggaaccacgtcgtacggtaccgtcgtacggtaccaccggacccgtaacggtcccgttcccgtccccgttcggtaccctaccgttcccgttcccgttacccccgtaacccttcccgtaaccgtaccgtacggttacgtaacgttcgggaacgg

SEQ ID NO: 341099 - DNA, 801 bp, Homo sapiens
  misc_feature: GZ8MTXP01AW3A6.15.56.F01.1.454.CMB.2.raw
  modified_base (231)..(231): a, c, t, g, unknown or other
  misc_feature (231)..(231): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtacaacntcaccagcaaacgccccaaatcatgatttatagaggacaagtgagccggtccctcgtaggggtttctaatcgtcttctcgtcggctaccaagtctacgaaccaacgacccggtccctaccgtgaacaactcgtcgtcgggtcctaccgaacgggtcgtagggaacggggtaaccgggtaaaggggttacgttaaattttaaacggtttaaccgttacgggcccgtttaaggcggtaacccttaaattaaacgttaacggtaaacccgttccccgttaaagtttcgggtttacggggtttacccgggttttttaccgggggaccggggttaaacggggaacccgttaaacgggcccggttaccggtaaccccgggttaacccggtttaacggggtaccgtaaccgggaccccggtaaacgggggtccccttaccccgggtccccccccgttcggggttaccccgttaaccctttacccgtttccccgggtttccccccttaaccccgttccccgttcccggtaacccgttacccgggtttaacgtaacccggttaacgggtaacccggggg

SEQ ID NO: 341100 - DNA, 598 bp, Homo sapiens
  misc_feature: GZ8MTXP01ELMJ4.15.56.F01.1.454.CMB.2.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
tcagtctacgtagccacgaccggtgctcgatttagcagacgtctgtcgggacgtctccaccatggcctgggctctgctgctcctcactctcctcactcaggacacagggtcctgggccccagtctgccctgactcagcctgcctccgtgtcctgggtctcctggacagtcgatcaccatctcctgcactggaaccagcagtgatgttggacttacacttgtctctgtacanatcaccagcaaacgccccaaancangattangaagacatgagcgcctgaggtttcaatcgnttctgtgctcagtctagacaacnccgcctaccgtanacactctcgtggctacgagcgaggaggagtagtatagttatgtgtcgtgacgtactaataacgtaacgtaccgtaccgtacgttgtttacggggttacgggtttacggggaacgggtaacggtaaccgtaacggtccgttacggtaccgtaccgtacggtaccgacggaccgtaacggtcccgttccggtccccgttcgtaccttccgttcccgttcccgttacccctaaccccgtcgtccgtacgtacgttacgtaacgttcggaacgg

SEQ ID NO: 341101 - DNA, 685 bp, Homo sapiens
  misc_feature: GZ8MTXP01B15CF.15.56.F01.1.454.CMB.2.raw
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgagtgttggacttacacttgtctcctgtacaantcaccagacaacgccccaaactcatgtattagngaagacaatgacgccgtcctgtacgggtttctaactcgtcttctcgtcggtctacgagtctacgaaccaaccgtaccccggtcccctaccgtacgaacctaacgttcccgtacggtcggggtcctaccggacgggtcgtagggaacgggtacgggtagggttagtaatttaacgttcgtcgcgttggacgtacgtaagtaacgtacgtaacgtcccgtaagtttcggtttacgggtttaccgggttttacggggaccgggtaacgggtaaccgtaaacggtccgttacggtacccgttaccgtacgggttaccaaccggacccgtaacggtcccgttcccggtcccccgttcggtacctccgttcccttcccgttccccgtaaccctccgtcctacgtacgttaggtccgttcggccggg

SEQ ID NO: 341102 - DNA, 554 bp, Homo sapiens
  misc_feature: GZ8MTXP01AMVL2.15.56.F01.1.454.CMB.2.raw
  modified_base (362)..(362): a, c, t, g, unknown or other
  misc_feature (362)..(362): n is a, c, g, or t
  modified_base (405)..(405): a, c, t, g, unknown or other
  misc_feature (405)..(405): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaactcatgatttatgaggacaatgagcggccctcgaggggtttctaatcgcttctcgtggctccaagtctgacaacgacccggcctcctgacaatctctgggcnccgagcgtgagggacgagggtgtattatactgctgacgcatanagaacgtcccacgttgttgggttacgtttcgggcggtacgggaccaaggctcgaccgtccgtaggtcacgcccaaggccttcgccccttggtcctcgttccttccgttcccctaacccgtcctcgcctacgttacgaacgttgaacggg

SEQ ID NO: 341103 - DNA, 663 bp, Homo sapiens
  misc_feature: GZ8MTXP01ADEC5.15.56.F01.1.454.CMB.2.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgaaccaanatcaccagacaacgccccaaatcatgtattangagacaatgagcgcctagtagggtttacaactcgtcttcgtctggactccgaagtctagaacaaccgaccccggtcctacctagtactaacttccgtcgtcgggtcctacccgagggaccgtagggacgggtaacggtagggtnttaatttacgttaccgtgtacctgaccgnttaagtaagtacgtaaacgttccccgtaagtttcgtttacggggttacggtttcggggacggaacgggtacacgtgtaccggtacccgtacgttacggcccacggcccgtaacggtcccttccccggtaccccgttcggtacctccctttcccgttaaccccgttcccccgttaaccccgtcgttaacccgtcgtaaccggttacgtaacccgttgggaaccccggg

SEQ ID NO: 341104 - DNA, 747 bp, Homo sapiens
  misc_feature: GZ8MTXP01EUWZB.15.56.F01.1.454.CMB.2.raw
  modified_base (265)..(265): a, c, t, g, unknown or other
  misc_feature (265)..(265): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgtctctgtaccaacatcaccaggacaaacgccccaaatcatgattangagacaagtgacgccggtccctcgtacggggtttactaacgtctactttcgtcgtcggtcctaccgtaagtctacgaactaaccgaccccggtccctccgtacgaacctaaccgttacgtcgtcggggccctaccgggacgggacgttacgggaacggggacgggtagggtagttatttaagttaacgtcggtcgtagggtaccgtacgtaacgtttaaacgtaacgttaaacccgggttacccttaacgggttttacgggtttttaccggggtttaacccggggttttttacgggggaaccggggttaaacggggaaccccgtaaagggtccgtaaccgggttaccccgttaccggtacgggttaccgacccggtacccggtaacgtcccgttaccgtcccccgttcgtacccgtccttccgttccctttccccgcccttcccgtcgtaacccgtacgttacgtaacgttgggtaaccggg

SEQ ID NO: 341105 - DNA, 633 bp, Homo sapiens
  misc_feature: GZ8MTXP01EVKFG.15.56.F01.1.454.CMB.2.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtggaaccngcagtgatgttggacttacacttgtctctgtaccacatcaccagacaaaccgccccaaatcatgtattangaaggaacagtcgacgccggtacccgtgtacgggtttactaatcgtcttcgtacgtcggtacctaccgtaagtctacgaaaccctaaccgtacccccggcccttaccgagtaacctacgtccgtacgtcgggcctaccgaggcgtagggaagggacggtagggtataattactacgtcgccgtgtaccgataaatacgtaacgtaacctcccgtaagttcgtttcggggtttacggtttaccgggacgggtacggaccttaacggcttacggaccgtcgtacgccacgccgaacggtccttccgcccgttcgtacctcttccgttccgttacccctcccgtctccgtactacgttctcgttaacgcgg

SEQ ID NO: 341106 - DNA, 749 bp, Homo sapiens
  misc_feature: GZ8MTXP01A1I5I.15.56.F01.1.454.CMB.2.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatccaccatctcctgcactggaaccngcagtgatgttggacttacacttgtctctgtaccaantccaccagacaaacgccccaatcatgattanagagacaatgacgccgtcctcgtagggtttactaacgtcgacttctcgtcggtacctacgtaagttcctacgaacccaaccgaccccggtccctaccgtagaaccctaacgttacccgttccgtcgggggtccctaccggacgggtaccgtggggaacggggtacgggtaagggttacggttatttaacgttcgcgtccgtgtacggaacttataacgtttaaacggacccttaaccgtacgtttcgggtttacggtttacccgggtttcggggaaccggggtaaccggtaacccgtaaaggtccgtacccgggtaaccgtccggttaaacgggtacccacggtaccccgtaacgggtccccgttcccggggtcccccccttacgggtacccgttcccttcccgttaccccgggtttccccccctcccgttaaccggtcccgttaacccggttaccgggttacggtaaccgtttcgggcccggggg

SEQ ID NO: 341107 - DNA, 663 bp, Homo sapiens
  misc_feature: GZ8MTXP01B19JF.15.56.F01.1.454.CMB.2.raw
  modified_base (259)..(259): a, c, t, g, unknown or other
  misc_feature (259)..(259): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggacttacaacttgtctcctggtaccaacatcaccaggcaaagcccccaaatcangatttatagaggacaatgagcgccctcgaggggtttctaatcgacttctctgggtctcaagtctgactaacacccggcctcctagacaatcctctcgggcctaccgagggctgaggacgagggtanagttatacgncgtgcgctatatacgtaaacgaccctaacgttggttacggttacgtttttacggggaccgggtagggaacccgaaaacggtccgttacggtaaaccccggttcccgtaacggggttaacccgtacggacccccgaaaacgggtcccgttacccggttccccccccgttaacgggttcccaaccctttcccgtttacccgttcccccgtaaccccttcccccgtaacgtaccctaaccgggttaacgtaacccgttgggtaacccgggg

SEQ ID NO: 341108 - DNA, 862 bp, Homo sapiens
  misc_feature: GZ8MTXP01EOIU8.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatcctcctgcactggaaccagcagtgagtgttggacttacacttgtctctcgtaccaacataccacccaggacaaaccgacccccaaatcatagtattagtaggaaggagaagtaggacggtcccggtccccgtacgttaacggggttttactaacgtccgtacctttcgtcgttcgggtacctacctaagttccgtacgaaaccgtaaccgacccccggtaccccttaccgtacgtaacctaaccgttacccgttccggttccgggacccgttacccgggacgggtaccggttacgggggaaacggggtaccgggttaaagggggttactttaacgtttaacgtttaccgtacggtcgttacggtaacccggtattaaacgttaacgtaaaccggtaaacccgttaccccgtttaaagttttcggggtttttaaccggggtttaacccggggtttttaccgggggaaccggggtaaacggggtaaaccccgttaagggttaccccgttacgggtaaccccggttaccggttacggggtaacccaccccggaacccggtaacgggtccccgttcccccggtccccggtttacgtaccgttttacccttcccggtttccccgttacccccgtaaccccgttcccgtaaccgttcccggttacggttaccgtcggttaacgggccgggg

SEQ ID NO: 341109 - DNA, 633 bp, Homo sapiens
  misc_feature: GZ8MTXP01ADXM7.15.56.F01.1.454.CMB.2.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctggtctcctggacagtcgatcaccatctcctgcactggaaccagcagtgattggttggacttaactaccttgtcctcctgtaaccaatacaccacccgaggaccaaaccgcccccaaatcatgtattangaganaagtgagccgtcctagtaggtttactatcgcttcgtcgtcggtacctaccgtaagttctacgaacaaccgtcccgtcccctctagtactactccgtacgtcggtcctacgtaggcgtagggagggtacgtagggtacttagttaagtcgtggctgtacgattaagtactacgtacctacctgtttgttacgggttcggttcgggagaccggacagtccgacggtccgttacgtaggccacggaaccctcggtcgttccccgtcccgttcgtccctacgttcccgtttccccggttacccctcccgttaccgtcggtacccttacggaccgtaaccggttggaaccgggg

SEQ ID NO: 341110 - DNA, 525 bp, Homo sapiens
  misc_feature: GZ8MTXP02HTCJJ.15.56.F01.1.454.CMB.2.raw
  modified_base (291)..(291): a, c, t, g, unknown or other
  misc_feature (291)..(291): n is a, c, g, or t
  modified_base (346)..(346): a, c, t, g, unknown or other
  misc_feature (346)..(346): n is a, c, g, or t
  modified_base (493)..(493): a, c, t, g, unknown or other
  misc_feature (493)..(493): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaactcaatgattatgaggacaatgagcgccctnaggggtttcaatcgcttctctggctcaagtctgacacaccgcctcctgacaatcnctgggctccagctgaggacgagggtgattattactgctgcgcatatagaacgtccacttgtttgtacgtttttcggcggtaggggaccaagctgaccgtcctaggtcacgcccaaggcctcgccccctcggtccactctcgttcccncccgtccctcgtctacgttacgacttcgacgg

SEQ ID NO: 341111 - DNA, 513 bp, Homo sapiens
  misc_feature: GZ8MTXP02JDIF0.15.56.F01.1.454.CMB.2.raw
  modified_base (494)..(494): a, c, t, g, unknown or other
  misc_feature (494)..(494): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttcaatcgcttctctggctccaagtctgacaacaccggcctccctgacaatctctgggactcaggctgaggacgagggtgattatactgctgcgcatatagaagtccactgttgtacttttcggcggtagggaccaaggctgaccgtctaggtcagcccaaggctcgccccctggtcactctcgttcccaacctccncgtctacgtgacctgacgg

SEQ ID NO: 341112 - DNA, 509 bp, Homo sapiens
  misc_feature: GZ8MTXP02I9RYM.15.56.F01.1.454.CMB.2.raw
  modified_base (289)..(289): a, c, t, g, unknown or other
  misc_feature (289)..(289): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctnaggggtttctaatcgcttctctggctccaagtctgacacaccgcctccctgacaatctctgggctccaggctgaggacgagggtgattatactgctgcgcatatagaagtccactgttgtacgttttcggcggtagggaccaagctgaccgtctaggtcagcccaaggctcgcccctcggtcactctcgtcccgccctcctcgctacgtacgactgacgg

SEQ ID NO: 341113 - DNA, 523 bp, Homo sapiens
  misc_feature: GZ8MTXP02HOT1P.15.56.F01.1.454.CMB.2.raw
  modified_base (236)..(236): a, c, t, g, unknown or other
  misc_feature (236)..(236): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaanatcaccaggcaaagcccccaaactcatgatttatgaggacaaatgaagcggccctcgtaggggtttctaatcgctttctctggctccaaagtctagacaacaccggcctcctgacaatctctgggctcagctgaggacgagggtgattattactgctgcgcatatagacgtccattgttgttacgttttcggacggagggtaccaagcgtagaccgtccgtagtcacgcccaacgctccgccctcggtcactctcgttcccgcctcctcgctacgtacacgtcgcgg

SEQ ID NO: 341114 - DNA, 518 bp, Homo sapiens
  misc_feature: GZ8MTXP02HTE56.15.56.F01.1.454.CMB.2.raw
  modified_base (374)..(374): a, c, t, g, unknown or other
  misc_feature (374)..(374): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaacttgtctcctggtaccaacatcacccaggcaaaagcccccaaatcatgattatgaggacaatgagcggccctcgaggggtttcaatcgcttctctggctcaagtctgacaacaccgcctccctgacaatctctgggctccaggctgaggacgagggtnagttatatgctgcgcatatagaacgtcccaattgttgttacgttttcggcggtagggaccaagctgaccgtcgtagtcagcccaacgctccgccctcggtcctactcctcgttcccaacccgtctcgctacgtacgactgacgg

SEQ ID NO: 341115 - DNA, 612 bp, Homo sapiens
  misc_feature: GZ8MTXP02F7T6M.15.56.F01.1.454.CMB.2.raw
  modified_base (231)..(231): a, c, t, g, unknown or other
  misc_feature (231)..(231): n is a, c, g, or t
  modified_base (384)..(384): a, c, t, g, unknown or other
  misc_feature (384)..(384): n is a, c, g, or t
tcagtctacgtagccacgaccggtgctcgatttagcagacgtctgtcgggacgtctccaccatggcctgggctcctgctgctcctcactctcctcactcaggacacagggtcctgggcccagtctgccctgactcagcctgcctccgtgtctggtctcctggacagtcgatcaccatctcctgcactggaaccagcagtgatgttggacttacaccttgtctctgaccacntcaccagcaaacgccccaaatcatgattatgagacaatgagcggcctgacgggtttctaatcgcttcgtcgtggcctacgagtctagaactaacgacccgtccctacctagactaactctcgtcgggcctccgagcgtagaggacggagggtnattactactgctgtcgctaatagtacgaacgtcctattgttacgttacgtttcgggacggtacgggaacaacgtcgtacgtaccgtacgtacggtaccgacgaccccgaacggtcccgttacccggcccccggttaccggtaccgtacccgttacccgttacccggtttaccccctaacccgttcccgtaccgtaccgttacggtaccgtaacggtcggtacccgggg

SEQ ID NO: 341116 - DNA, 513 bp, Homo sapiens
  misc_feature: GZ8MTXP02I0423.15.56.F01.1.454.CMB.2.raw
  modified_base (496)..(496): a, c, t, g, unknown or other
  misc_feature (496)..(496): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaactcatgattatgaggacaatgagcggccctcaggggtttctaatcgcttctctggctccaagtctgacaacaccggcctccctgacaatctctgggctcaggctgaggacgagggtgattattactgctgcgcatataagagtccactgttgtacttttcggcggagggaccaagctgaccgtcgtagtcacgccgaacgctcgcccctcggtcactctcgttccctaaccctcctcnctactacgactgtacgg

SEQ ID NO: 341117 - DNA, 539 bp, Homo sapiens
  misc_feature: GZ8MTXP02ID0V8.15.56.F01.1.454.CMB.2.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaacttgtctcctggtacaantcaccaggcaaagccccaaactcatgattatgaggacaatgagcggccctcgaggggtttctaatcgcttctctggctccaaagtctgacaacnccggcctccngacaatctctggctcagctgaggacgngggtntatattactgctgcgacataatagagtcccattgtttagttacgttttcgggcggtaagggaccaagcgtacgaccgtcgtaggtcacgacccaaggcctcgccccctcggtccaccgttcctcgttcccccgccctaccctccgtcctacgtacgaccgttgaccggg

SEQ ID NO: 341118 - DNA, 592 bp, Homo sapiens
  misc_feature: GZ8MTXP02H4N1L.15.56.F01.1.454.CMB.2.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctggtaccaanatcaccatgacaaacgcccccaaatcatgatttangagacaatgagccggcctcgtaggggtttctaatcgtcttctctggctaccaagtctagacaaccgaccggccctccctagacaatcctcgtcgggctcccgagctggaggacggagggtagatttagttactgcgtcgcgactataatagaactcccgtattgtttcgttacgttttccgggacgggtacgggaaccaagccgtacgaccgttaccgtacggtacgacgacccgaacggtcctccgtcccccgtcggtaccctaccttcccgttcccgttcccctaccccttcccgtccgtacctaccggtacgtaccgtcgg

SEQ ID NO: 341119 - DNA, 546 bp, Homo sapiens
  misc_feature: GZ8MTXP02IUT80.15.56.F01.1.454.CMB.2.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccaacatcaccagcaaacgccccaaactcatgatttatgaggacaatgagcggccctgtaggggtttcaatcgcttctctggctcaagtctgacacnccgcctcctnacatctcnggctcaggctgaggacgagggtgtattattactgctgcgactatataagacgtccattgtttgttacgtttcgggacggagggaccaagcgtacgtaccgtaccgtaggtaccacgcccgaaacggccgtccgcccccgttcggtccctaccgttccgtccgttccccgcccttccgtccgtcgtaccgtacgcgtacggcgg

SEQ ID NO: 341120 - DNA, 583 bp, Homo sapiens
  misc_feature: GZ8MTXP02HBLOC.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaactcatgattatgaggacaatgagcggccctgaggggtttctaatcgcttctctggctccaagtctgacaacaccggcctcctagacaactctctgggcctcgaggctggaggacgagggtgattattactgctgcgcataatacgaacgtcccacgttgttacgttactttttcggggacgggtacgggggaaccaaaggcctacggtacccgtccgtaggtccaacgccccgaaacggtccgtccgcccccgtggtacccaccgttccttcggttcccccaacccgttccctccgtacctaccgtacgtaccgtcggaccggg

SEQ ID NO: 341121 - DNA, 524 bp, Homo sapiens
  misc_feature: GZ8MTXP02GSNYQ.15.56.F01.1.454.CMB.2.raw
  modified_base (393)..(393): a, c, t, g, unknown or other
  misc_feature (393)..(393): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgatttatgaggacaaatgagcggccctgaggggtttctaatcgcttctctggctcaagtctgacaacaccggcctcctgacatctctgggctcaggctgaggacgagggtgattatactgctgcgcatanagaacgtcccatgttgtacgttttcggcggtacggggaccaagctcgaccgtacctaggtcacgccctaaggcctcgcccctcggtcacctctcgttcccaacccgtcctcgctacgtacgacgtcgacgg

SEQ ID NO: 341122 - DNA, 523 bp, Homo sapiens
  misc_feature: GZ8MTXP02I8YFR.15.56.F01.1.454.CMB.2.raw
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccantcaccagcaaagccccaaatcatgattangagacaatgagcgccctgagggtttcaatcgcttcnctggctccaagtctgacacaccggcctcctgacatctctgggctcagctgaggacgagggtnattattactgctgcgcatatagacgtccctagttgttgttaaccgttttcgggacgggtacgggaccaacgtcgtacggacccgttccgtaggtacacgcccgaacggctcgccccctggtccacgtcctcgttccccgcctccctcgtctacgtacgactgacgg

SEQ ID NO: 341123 - DNA, 508 bp, Homo sapiens
  misc_feature: GZ8MTXP02IZJ6X.15.56.F01.1.454.CMB.2.raw
  modified_base (372)..(372): a, c, t, g, unknown or other
  misc_feature (372)..(372): n is a, c, g, or t
  modified_base (488)..(488): a, c, t, g, unknown or other
  misc_feature (488)..(488): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaatcatgattatgaggacaatgagcggccctgagggtttctaatcgcttctctggctccaagtctgacaacaccgcctcctgacatctctgggctcaggctgaggacgagggtnattatactgctgcgcatatagacgtccatgttgtacgtttcggcgtagggaccaagctagaccgtcgtagtcacgcccgaagctcgcccctcggtcacctctcgtcccgccctccncgtctacgtacgactcgcgg

SEQ ID NO: 341124 - DNA, 534 bp, Homo sapiens
  misc_feature: GZ8MTXP02F56YL.15.56.F01.1.454.CMB.2.raw
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
  modified_base (396)..(396): a, c, t, g, unknown or other
  misc_feature (396)..(396): n is a, c, g, or t
  modified_base (524)..(524): a, c, t, g, unknown or other
  misc_feature (524)..(524): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaactcatgatttangaggacaatgagcggccctcgaggggtttctaatcgctttctctggctccaaagtctgacaacaccggcctcccngacaatctctggggcctccgaggctgaggacgaggggtgatttattacngctgcgcatatagaaacgtcccaacttgtttgttacgttttcgggacgggtagggaccaagctgaccgtctaggtcacgcccaaggcctcgcccctggcacgtctcgttcccaaccctcctcgctacncgactgacgg

SEQ ID NO: 341125 - DNA, 532 bp, Homo sapiens
  misc_feature: GZ8MTXP02J1H1U.15.56.F01.1.454.CMB.2.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (496)..(496): a, c, t, g, unknown or other
  misc_feature (496)..(496): n is a, c, g, or t
tcagtctacgtagccacgaccggtgctcgatttagcagacgtctgtcgggacgtctccaccatggcctgggctctgctgctcctcaatctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaaactcatgatttatgaggacaatgagcggccctcaggggtttctaatcgcttctctggctcaagtctgacaacaccggcctcctgacaatctctgggctccaggctgagacgagggtgattatactgctgcganatanagactctattgttgttacgttcggcggacggacagcgtacgaccgtcgtagacgacgaccgacgcgtccgccccgtcgtcctacctcctcccgttcccncccgtccgtacgtacgtacgtacgtacgtcggacgg

SEQ ID NO: 341126 - DNA, 534 bp, Homo sapiens
  misc_feature: GZ8MTXP02HUVTZ.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcaccaggcaaagcccccaaactcatgattatgaggacaatgagcgccctcgagggtttcaatcgcttctctggctccaagtctgacacaccgcctcctgacatctctggctcagctgaggacgagggtgattattacgtgctgcgcatatagagtcccactgttgttacgttttcgggacggtaggggaccaagtctacggtaccgtaccgtacggtcacgacccaacggcctcgcccccgtcggtacacctcctccgtccccaacccttcctccgtctacgtacgactacgacgg

SEQ ID NO: 341127 - DNA, 498 bp, Homo sapiens
  misc_feature: GZ8MTXP02I0V3B.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaatcatgattatgagacaatgagcggccctcgagggtttcaatcgcttctctggctccaagtctgacacaccgcctcctgacatctctgggctccagctgaggacgagggtgattattactgctgcgcatatagaagtccatgttgtacttttggcggtagggaccaagctgcgtctaggtcagccaacgctcgcccctcggtctctctcgtcccgcctcctcgctacgtacgacgtgacgg

SEQ ID NO: 341128 - DNA, 517 bp, Homo sapiens
  misc_feature: GZ8MTXP02GDGWM.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaatcatgattatgaggacaatgagcggccctcgaggggtttcaatcgcttctctgctcaagtctgacaacaccgcctcctgacatctctgggctcaggctgaggacgagggtgattattactgctgcgcatatagacgtcccattgttagtacttttcgggcggagggtaccaagctagaccgtctaggtcacgcccaaggctcgcccctcggtcactctcgttcccaacccgtcctcgacctacgtacgacgtgacgg

SEQ ID NO: 341129 - DNA, 529 bp, Homo sapiens
  misc_feature: GZ8MTXP02GZAOK.15.56.F01.1.454.CMB.2.raw
  modified_base (236)..(236): a, c, t, g, unknown or other
  misc_feature (236)..(236): n is a, c, g, or t
  modified_base (400)..(400): a, c, t, g, unknown or other
  misc_feature (400)..(400): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaanatcaccaggcaaagcccccaaatcatgattatgaggacaatgagcggccctgaggggtttcaaatcgcttctctggctccaagtctgacaacacccggcctccctagacaatctctcggggctccaggcctggaggacgagggtgattatactgctgcgcatanagagtccatgttgtacgtttcggcggagggaccaagctacgaccgtctaggtcacgacccgaacggctcgcccccgtcggtccacgtcctcgttcccaaccctcctccgctacgtacgacgtcgtacgg

SEQ ID NO: 341130 - DNA, 569 bp, Homo sapiens
  misc_feature: GZ8MTXP02JJBH6.15.56.F01.1.454.CMB.2.raw
  modified_base (233)..(233): a, c, t, g, unknown or other
  misc_feature (233)..(233): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccaacntcaccagcaaagccccaaactcatgattatgagacaatgagcggccctgtagggtttctaatcgcttctctggctcaagtctgacaacaccgcctccctgacatctctcgggctccaggcctggaggacggagggtgatttattactgcgtgcgctaatagtaagacgtacccaacgttgtttacgttacgtttttccgggacgggtacgggaaccaaggtccgtacgaacccgttcgtacggtcacgcccgaacggtccgtccggcccccgtcggtacctccgttccgttccgttccccgccctcccgtccgtacctacgtacgtacgtcgcggg

SEQ ID NO: 341131 - DNA, 500 bp, Homo sapiens
  misc_feature: GZ8MTXP02HPQM2.15.56.F01.1.454.CMB.2.raw
  modified_base (343)..(343): a, c, t, g, unknown or other
  misc_feature (343)..(343): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctgagggtttctaatcgcttctctggctcaagtctgacacaccgcctcctgacatcnctggctcagctgaggacgagggtnattatactgctgcncatatagaagtccattgttgttacgttttcggacggtagggacagctgaccgtctagtcacgaccgagctcgcccctcgtcactctcgtcccaaccgtctcnctacgtacncgtagcgg

SEQ ID NO: 341132 - DNA, 553 bp, Homo sapiens
  misc_feature: GZ8MTXP02HTYFS.15.56.F01.1.454.CMB.2.raw
  modified_base (342)..(342): a, c, t, g, unknown or other
  misc_feature (342)..(342): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaacgccccaaactcatgattatgagacaatgagcgcctgagggtttcaatcgcttctctgctcaagtctgacacaccgcctcctgacatctcnggactccaggcctggaggacgtagggtgattatatgctgcgcatatagtaagtccctattagttgttacgtttttcggacggtagggaccaagctacggaccgtccgtaggtcgacgacccgaacggcgttccgcccccgttcgggtcctaccgttcctccggttccccaacccttcccgtccgtacctacgttaacgacgttcgaccggg

SEQ ID NO: 341133 - DNA, 547 bp, Homo sapiens
  misc_feature: GZ8MTXP02IZH4M.15.56.F01.1.454.CMB.2.raw
  modified_base (371)..(371): a, c, t, g, unknown or other
  misc_feature (371)..(371): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaatcatgattatgaggacaatgagcgccctgagggtttctaatcgcttctctggctccaagtctgacacaccgcctcctgacaatctctgggctccaggcctgaggacgagggtnagttatactgctgcgcatatagaaacgtccctaacttgttagttacgttttcgggacggtagggacccaaagctagaccgtccgtaggtacagccccgaaaggcctcgcccccgtggtacctaccgtcctcgttcccccaacccttcccctcgtcctacgtacgtacgtcggacgg

SEQ ID NO: 341134 - DNA, 564 bp, Homo sapiens
  misc_feature: GZ8MTXP02F9XRG.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccaacatcaccagacaaacgcccccaaactcatagattatgaggaacaatgagccggccctgtagggtttactaatcgtcttctcgtggcctccaagtctacgaacaacgacccgccctcccgtgacctaatccttcgtcggggtcctcccggaggtcgtaggaagggacgggagggtatagtttattactgtctgcgactatatagacgtacctagttgttcgttacgtttcggacggaggacaagtctagaccgtcgtagtcacgaccgaggctccgccccgtcgtctacctccgtccttccccaaccttccgtcgactacgacgtactcggacgg

SEQ ID NO: 341135 - DNA, 576 bp, Homo sapiens
  misc_feature: GZ8MTXP02H5T3Q.15.56.F01.1.454.CMB.2.raw
  modified_base (261)..(261): a, c, t, g, unknown or other
  misc_feature (261)..(261): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgcccccaaancatgattatgagacaatgagcgccctgtagggtttcaatcgcttctctggctcaagtctgacaacaccgcctcctgacatctctgggcctccaggctgaggacgagggtgtatattacngctgcgcatanagtacgtccagttgttcgttacgttttcggcgggtacgggaccgaagtcgtacgtaccgtcgtacggtacacgacccgtaaacggcctccggtccccccgtcgggtaccctaccgttcccgttccgttcccccgaacccccttcccgtaccgtaccgttaaccgtacggtacgttacggccgggg

SEQ ID NO: 341136 - DNA, 553 bp, Homo sapiens
  misc_feature: GZ8MTXP02H1OMW.15.56.F01.1.454.CMB.2.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctctgtaccaanatcaccagcaaagccccaaatcatgattangaggacaatgagcggccctcgtaggggtttctaaatcgctttctctgctcaagtctagacacaccgcctccctgacatctctgggctcagctagagacgagggtnattatactgctgcgcatanagatcccattgttagttacgttttcgggaccgggagggaccaagctgtaaccgtcgttaaggcaaggcccaaaagggccttcggcccccctaggtacctacctccgtttcggttccccccgtcccgtccgtaccgtaccgttaacggtacgtacgtacggtacgg

SEQ ID NO: 341137 - DNA, 528 bp, Homo sapiens
  misc_feature: GZ8MTXP02JP76L.15.56.F01.1.454.CMB.2.raw
  modified_base (383)..(383): a, c, t, g, unknown or other
  misc_feature (383)..(383): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaactcatgatttatgaggacaatgagcggccctgaggggtttcaatcgcttctctggctcaagtctgacaacaccgcctcctgacaatctctgggctcaggctgaggacgagggtgattattacngctgcgcatatagaagtccctaatgtttacgtacgttttcgggacggtacggggacccaagctaggaccgtcctaggtccacgcccgaacggctcgccccctggcactctacgttcccaaccgtctcgctacgtacgactgacgg

SEQ ID NO: 341138 - DNA, 513 bp, Homo sapiens
  misc_feature: GZ8MTXP02GD0NK.15.56.F01.1.454.CMB.2.raw
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaactcatgatttatgaggacaatgagcggccctcaggggtttctaatcgcttctctggctccaagtctgacacaccggcctccctgacaatctctgggctcaggctgaggacgagggtgattattactgctgcgcatatagaaagtccacttgttgtacttttcggcggtagggaccaagctgaccgtctaggtcagcccaagctcgcccctggtcactctcgttcccaaccctcctccnctacacgacgngacg

SEQ ID NO: 341139 - DNA, 520 bp, Homo sapiens
  misc_feature: GZ8MTXP02J0QJL.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggcccctgaggggtttctaatcgcttctctggctccaagtctgacaacaccggccctcctgacaatctctgggctccgaggctgaggacgagggtgattattactgctgcgcatatagagtcccattgttgttacgtttcggcgggagggaccaagccgtgaccgtctaggtcacgcccaaggctcgccccctggccactctcgtcccgccctcgcgtctacgtacgacgtgacgg

SEQ ID NO: 341140 - DNA, 513 bp, Homo sapiens
  misc_feature: GZ8MTXP02HHUL3.15.56.F01.1.454.CMB.2.raw
  modified_base (389)..(389): a, c, t, g, unknown or other
  misc_feature (389)..(389): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgattatgagacaatgagcgcctcaggggtttcaatcgcttctctgctcaagtctgacaacacccgcctcctgacaatctctgggctccgaggctgagggacgtagggtgtattattactgctgcncatatagagtccctactgttagtacgttttcggacggagggaccaagctgtaaccgtctaggtcagcccaaaggcctcgccccgtgtcactctcgttccccncctctcgctacgacgacgngcg

SEQ ID NO: 341141 - DNA, 525 bp, Homo sapiens
  misc_feature: GZ8MTXP02IATOL.15.56.F01.1.454.CMB.2.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttanaaccttgtctctggtaccaanatcaccaggcaaacgccccaaatcatgattatgaggacaatgagcgcctgtagggtttctaatcgnttctctggctcaagtctgacacaccgcctcctagacatctctgggcctcgagctgaggacgaggtgattattactgctgcgctatatagtacgtcctagttgttgttacgttttggacgggtaggacgaagcgtcgaccgtcgtaggctacgcccgtaacggctcgcccctcggtctacctcgttccgtccccgtccctcccgtcgctacgtacgtacgtgcgg

SEQ ID NO: 341142 - DNA, 552 bp, Homo sapiens
  misc_feature: GZ8MTXP02FQ7Z5.15.56.F01.1.454.CMB.2.raw
  modified_base (288)..(288): a, c, t, g, unknown or other
  misc_feature (288)..(288): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaactcatgattatgagacaatgagcggccctnaggggtttctaatcgcttctctggctccaaagtcctgacaacaccggcctccctgacaatctctggggctccaggctgaggacgagggtgattatactgctgcgcatagtagaaacgtcccaacttgttgttacttttcgggacggtaagggaccaaaggctacggaccgttaccgtaggtacgacgaccccgaaagggcctccgcccccgtcggtaccaccttctcgttccccaacccgtcctcgctacgtacgactggacgg

SEQ ID NO: 341143 - DNA, 513 bp, Homo sapiens
  misc_feature: GZ8MTXP02IZ3UI.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctcgaggggtttctaatcgcttctctggctccaagtctgacacaccgcctcctgacatctctgggctccaggctgaggacgaggtgattatactgctgcgcatatagacgtccatgttgtacttttcggcggtagggaccaagctgaccgtcgtaggtacacgtacccaacggctcgccccctcggtcacctctcgtcccgccctcctcgctacgtacgactgacgg

SEQ ID NO: 341144 - DNA, 533 bp, Homo sapiens
  misc_feature: GZ8MTXP02F7PVB.15.56.F01.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (372)..(372): a, c, t, g, unknown or other
  misc_feature (372)..(372): n is a, c, g, or t
tcagtctacgtagccacgaccggtgctcgatttagcagacgtctgtcgggacgtctccaccatggcctgggctctgctgctcctcaatctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattangagacaatgagcgccctnagggtttcaatcgcttctctggctccaaagtctagacaacaccggcctccctgacaatctctgggctcaggctgaggcgagggtnattattatgctgcgcatagtagaacgtcccaacttgttgttacgttttcgggcggtagggaccaagctagaccgtctaggtacagccctaacggctcgccccctcggtcctactccgtcgttccccaaccctccctcgtacctacgttacgacctggacgg

SEQ ID NO: 341145 - DNA, 537 bp, Homo sapiens
  misc_feature: GZ8MTXP02ISNPR.15.56.F01.1.454.CMB.2.raw
  modified_base (233)..(233): a, c, t, g, unknown or other
  misc_feature (233)..(233): n is a, c, g, or t
  modified_base (380)..(380): a, c, t, g, unknown or other
  misc_feature (380)..(380): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtaccaanatcacccagcaaacgccccaaatcatgatttatgaggacaatgagcggcctcgtagggtttctaatcgcttctctggctcaagtctgacacacccgcctcctgacaatctctgggctcgaggctggaggacgagggtgattattacngctgcgcatatagaacgtccacttgtttgttacgttttcggcggtacgggaccaagctagaccgttccgtaggtcacgacccgaacggcctccgccccctcggtccaccttcctcgttccccgcccttccctcgtacctacgtacgacgtcggacgg

SEQ ID NO: 341146 - DNA, 577 bp, Homo sapiens
  misc_feature: GZ8MTXP02HM2R5.15.56.F01.1.454.CMB.2.raw
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccaanatcaccagcaacgccccaaactcatgattangagacaatgagcgcctgtagggtttacaatcgcttctctggctacaagtctgacaacgaccgcctcctgacaatctctgggctccgagctgaggacgtagggtnattattacngctgcganatatagacgtccctattgttgttacgtttggacggtagggaccaaggtccgtacgtaacccgttccgtaggtaccgacgtacccgaaggcccgttccggcccccctgggtacctaccgttcccgttcccggtttaccccccaaccccttccgtcccgtacccgttaaccggtacgtacccgtggtacccgggg

SEQ ID NO: 341147 - DNA, 523 bp, Homo sapiens
  misc_feature: GZ8MTXP02JMTM6.15.56.F01.1.454.CMB.2.raw
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctggtaccaacatcaccaggcaaagccccaaatcatgattatgagacaatgagcggccctgagggtttcaatcgcttctctggctcaagtctgacacaccgcctcctgacatctctggctcaggctgagacgnggtnattattangctgcgcatatagaacgtcccagttgttgttacgtttcggcggagggtaccaagctacgaccgtctaggtcacgcccaaggcctacggccccctggtactaccgtccttcgttccccaacctccctccggtactaccgttacgaccgtggacgg

SEQ ID NO: 341148 - DNA, 579 bp, Homo sapiens
  misc_feature: GZ8MTXP02FLXUN.15.56.F01.1.454.CMB.2.raw
  modified_base (230)..(230): a, c, t, g, unknown or other
  misc_feature (230)..(230): n is a, c, g, or t
  modified_base (263)..(263): a, c, t, g, unknown or other
  misc_feature (263)..(263): n is a, c, g, or t
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgccctccgtgtctgggtctcctggacagtcgatcaccatctcctgcactggaaccagcagtgatgtggacttacacttgtctctgtaccanatcaccagacaaacgccccaaatcatgtattangagacaatgagcggcctcgtagggttactaatcgcttctcgtggctacctaagttcagaacaacgacccggccctcccngaacaatcctcgtggggcctccgaggcctggaggaggagggttnatttattcgngntgcgacatagtaacgtacgtaccgtacgttagttagttacggttcgggtacgggacggaacgacgtacgtacgtaccgtacgtacgacgacgaccgacgccgtccgtcccgtccgtaccgtaccgttccgtccgttaccctaacccgtcccgtaccgtacgtacgtacgtacgtacggcgg

SEQ ID NO: 341149 - DNA, 519 bp, Homo sapiens
  misc_feature: GZ8MTXP02JT22A.15.56.F01.1.454.CMB.2.raw
  modified_base (331)..(331): a, c, t, g, unknown or other
  misc_feature (331)..(331): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgattatgaggacaatgagcggccctcaggggtttctaatcgctttctctggctcaagtctgacaacncccggcctccctgacaatcctctcgggctccaggcctgaggacgagggtgattatactgctgcgcatatagacgtccattgttgtactttcggcggagggaccaagctgaccgtctaggtcacgccacggctcgcccccgtggtccactcctcgttcccaacccgtcctcgctacgtagacctgacgg

SEQ ID NO: 341150 - DNA, 545 bp, Homo sapiens
  misc_feature: GZ8MTXP02I2FWN.15.56.F01.1.454.CMB.2.raw
  modified_base (272)..(272): a, c, t, g, unknown or other
  misc_feature (272)..(272): n is a, c, g, or t
  modified_base (509)..(509): a, c, t, g, unknown or other
  misc_feature (509)..(509): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaacgcccccaaactcatgattangaggacaatgagcggccctgtagggtttctaatcgcttctctggctccaagtctgacaacacccggcctcctgacaatctctgggctcaggctgaggacgagggtgattatactgctgcgcatatagacgtcctacttgttgttacgttttcggcgggagggaccaagctagaccgtaccgtaggtcgacgccgaacggctccgacccccgtcggtcctaccgtcctcgttcccccncccgtccctccgtccgtacgtacgtacgtacgacgg

SEQ ID NO: 341151 - DNA, 513 bp, Homo sapiens
  misc_feature: GZ8MTXP02GFBS4.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaacgccccaaactcatgatttatgaggacaatgagcgcctcaggggtttctaatcgcttctctggctccaagtctgacaacaccggcctcctgacaatctctgggctccagctgaggacgagggtgatttatactgctgcgcatatagaatccactgttgtacttttcggcggagggacaagctacgaccgtctaggtcagcccaaggctcgcccctcggtcacctctcgttccccaacctcctcctctacgtcgactcgacgg

SEQ ID NO: 341152 - DNA, 625 bp, Homo sapiens
  misc_feature: GZ8MTXP02GI2BA.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaagcccccaaatcatgatttatgaggacaatgagcggccctcgaggggtttctaatcgcttctctggctccaagtctgacaacaccggcctccctgacaatctctgggctcaggctgaggacgagggtgattatactgctgcgcatatagaacgtcccaacttgttagttacgtttttcgggacggagggggtacccaaaggtcgtacggtacccggttaccgtaacgggttccacggaccccgaaaacgggtcccgttccggccccccccgttcggggtaccctacccgtttcccgttccggtttccccccggcccccgtttccccgttccggtacccgttaacccggttacggtaaccgttcggaacccggggg

SEQ ID NO: 341153 - DNA, 526 bp, Homo sapiens
  misc_feature: GZ8MTXP02JP766.15.56.F01.1.454.CMB.2.raw
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (516)..(516): a, c, t, g, unknown or other
  misc_feature (516)..(516): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccantcaccagcaacgccccaactcatgattangagacaatgagccggcctgtagggtttctaatcgtcttctcgtggctccaagtctagacacaccgcctccngacatctcgtcgggctccgaggctagacggacgngggtgtattattacngctgctcatagagtacgcctagttgtttgttacgtttcggacggtacgggacagtctacgccgtcgtagtcgacgacccgaacgctccgccccgtcgacctctcctcgtccccaaccgtccctcgtactacgtcncgtcgacggg

SEQ ID NO: 341154 - DNA, 568 bp, Homo sapiens
  misc_feature: GZ8MTXP02HYACH.15.56.F01.1.454.CMB.2.raw
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtttgggacttacaaccttgtctcctggtaccaacatcacccaggcaaaagcccccaaatcatgattatgagacaaatgagcggccctcaggggtttctaaatgcttctctggctccaagtctgacaacaccggcctccctgacaaatctctggggctccacgcgtnagacgagggtagattattaatgtcngcgcatataagacgtactactgttgttacgtttacggtacggacgggacgaacgacgtacgtacgtacgtacgtacgacgaccgaacgacgtccgtcccgtcccgtaccgtacctcctccgttccctaaccccgtacccttaccccgtacccgtaccgtacgtacgtacggcgg

SEQ ID NO: 341155 - DNA, 598 bp, Homo sapiens
  misc_feature: GZ8MTXP02IU4LU.15.56.F01.1.454.CMB.2.raw
  modified_base (237)..(237): a, c, t, g, unknown or other
  misc_feature (237)..(237): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacntcacccaggcaaaacgcccccaaaactcatgatttatgaggacaatgagccggccctcgtaggggtttctaatcgcttctctggctccagtctgacacacccgcctccngacaatcnctggctcgagctgaggacgaggtgtattatactgcctgcgcatataagactcccgtattgttgttacgttttcgggacgggtagggaaccgaacgtcgtacgtacccgttaccgtaggtacgacggaccccgaacgggtcctccggccccccgttcgggtacctacccgttccgttcccggtttacccccgtccccgttccccgttccgtacccgttaccggttacgaacgttacggaccgggg

SEQ ID NO: 341156 - DNA, 516 bp, Homo sapiens
  misc_feature: GZ8MTXP02I97T1.15.56.F01.1.454.CMB.2.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (503)..(503): a, c, t, g, unknown or other
  misc_feature (503)..(503): n is a, c, g, or t
tcagtctacgtagccacgaccggtgctcgatttagcagacgtctgtcgggacgtccccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgatttatgaggacaatgagcggcctcaggggtttcaatcgcttctctggctccaagtctgacaacacggccctcctgacatctctgggctcaggctgagacgngggtnattagtactgctgcgcatatagaagtcccattgttgttacgttttcgggcggtacgggaccaagcctgaccgtcgtacggtcacgccaaggctcgcccctcggtcactctcgtcccgccctcgtcgctacgngactcgacgtcgg

SEQ ID NO: 341157 - DNA, 574 bp, Homo sapiens
  misc_feature: GZ8MTXP02JEQ23.15.56.F01.1.454.CMB.2.raw
  modified_base (237)..(237): a, c, t, g, unknown or other
  misc_feature (237)..(237): n is a, c, g, or t
  modified_base (388)..(388): a, c, t, g, unknown or other
  misc_feature (388)..(388): n is a, c, g, or t
  modified_base (536)..(536): a, c, t, g, unknown or other
  misc_feature (536)..(536): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacntcaccaggcaaagccccaaactcatgattatgaggacaatgaagcggccctcgtaggggtttctaatcgcttctctggctccaagtctgacaacaccggcctccctgacaatctctgggctcaggctagaggacgagggtgtattattacngctgcgcataatagaacgtcccacttgttacgttacgttttcgggcgggtaacggggacctaaggcgtacgacccgttacgttacggacacgacccgtaaggccgtccggcccccgtacggtcctaccttccgtaccgttaccccccncccgtcccgtacgtaccgtacgtacgtacgtacgacgg

SEQ ID NO: 341158 - DNA, 628 bp, Homo sapiens
  misc_feature: GZ8MTXP02GN3JN.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctctggtaccaacatcaccaggcaaacgccccaaactcatgattatgaggacaatgagcggccctcgtaggggtttctaatcgtcttctctggctaccaagtctagacacaccgcctcctagacatctcgtgggcctcgacggctgacggacgagggtctagttattacgtgcgtgcgctaataagtacgtaaacgtccctaacgttgtttacggttcgtttttacggggacgggtaacggggaacccaaaggtccgtacggtaccccggttaccgtaggttaccgacggacccgtaaacgggtcccgttacccggcccccgttaccgggccctacccgttccgtccggtttaccccctaacccttcccgtacccgttaccgtaccgaacgtcggtacggccgggg

SEQ ID NO: 341159 - DNA, 606 bp, Homo sapiens
  misc_feature: GZ8MTXP02JMNDJ.15.56.F01.1.454.CMB.2.raw
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaanatcaccagcaaacgccccaaatcatgattatgagacatgacgccgcctggtaggttacatcgtcttctcgtcgctacagtctanacacnccgtccctcagacatctcgtcggctcgagcgtaggaggacggtagggtatactttaagttcgtcgctgacgtactaagttacgaagtaccgttacccgtagtttgtttacgtttaccggtttcgggacgggtacgggtaaccacgtcgtaccggtaccgtacgtacggtaccaccggaccgtacggtccgtccccgtccccgtcgtacctaccgttcccgtcccgttacccctcccgttccgtacccgtaccgtaacgtaccggtacgtcggaacccgggg

SEQ ID NO: 341160 - DNA, 670 bp, Homo sapiens
  misc_feature: GZ8MTXP02J42R3.15.56.F01.1.454.CMB.2.raw
  modified_base (269)..(269): a, c, t, g, unknown or other
  misc_feature (269)..(269): n is a, c, g, or t
  modified_base (404)..(404): a, c, t, g, unknown or other
  misc_feature (404)..(404): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctgtaccaacatcacccaggcaaacgccccaaatcatgatttangaggacatgagcgcctcgtagggtttctaatcgcttctctggctccaagtctagacaaccacccggccctccctgactatcctcgtcgtcgacgcggtcgagaggacgggtaggtagtattaattcgtcgtcggntacggccattaataagtacgtacccgtccgttacgtttcggtttacgttaaccggtttcgggaccggggaacggtacccgaacggtccgtaccggtaacccgggtttcccgtaacgggtacccgaacccgggttaaccccgacgggggtccccttcccccggtcccccggttccggtaccccgttaaacccttcccgtttccccgttccccccgggtcccccttccgtaaacccgggtcctaacgggtttaacgacggtccggggg

SEQ ID NO: 341161 - DNA, 532 bp, Homo sapiens
  misc_feature: GZ8MTXP02JMDRU.15.56.F01.1.454.CMB.2.raw
  modified_base (234)..(234): a, c, t, g, unknown or other
  misc_feature (234)..(234): n is a, c, g, or t
  modified_base (322)..(322): a, c, t, g, unknown or other
  misc_feature (322)..(322): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaccttgtctcctgtaccaanatcaccagcaaagccccaaatcatgattatgaggacaatgagcgccctgagggtttcaatcgcttctctggctccaagtctgacaacnccggcctcctgacaatctctgggctcgagctgaggacgagggtnattatacngctgcgcatanagaacgtcccatgtttagtacgttttcgggcggtagggaccaaagcgtacggtacccgtcgtacggtcacgcccgaaacggctaccgccccctcggtaccacgttcctcgtccccaaccctccgtcgcctacgtacgacgtcgacgg

SEQ ID NO: 341162 - DNA, 529 bp, Homo sapiens
  misc_feature: GZ8MTXP02FQIQY.15.56.F01.1.454.CMB.2.raw
  modified_base (368)..(368): a, c, t, g, unknown or other
  misc_feature (368)..(368): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtaccacatcaccaggcaaacgcccccaaactcatgattatgaggacaatgagcggccctcgaggggtttctaatcgcttctctggctccaagtctgacaacaccggccctccctgacaatctctgggctcagctgaggacgnggtgattatactgctgcgctatagtagacgtcccattgttgttaacttttcgggcgggtagggaccgaagtcgtgaccgtctaggtcacgccaacgctcgccccctacggtcaccttctccgttccccaaccctcctacgtcctacgttacgacgtgacgg

SEQ ID NO: 341163 - DNA, 697 bp, Homo sapiens
  misc_feature: GZ8MTXP02GRA79.15.56.F01.1.454.CMB.2.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (650)..(650): a, c, t, g, unknown or other
  misc_feature (650)..(650): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccantccaccagacaacgaccccaatcatgattangagacagtgacgcgcccgtgtacgggtttacaactcgtcttcgtcgtcggtctaccgtaagtctacgaaccgtaaccgacccccggtcccttacccgtagaaccttaacttccgtcggtcggggtacctaccggacggggtacgtaggggaacggtacgggtagggttagttaacttttacgttacgtcggaccgttgaccgtactaagttaacgtaacggtaaaccgttccccgttaaggtttcgggttttacggtttacgggttttcgggggaccgggtaagggtacccgtaacggtcgtaccggtaccgtacgttacggaccgacgacccgtaacggtccgtaccgtccccgttcggtcctacccgttccgttcccggttcccccncccgttccgtacggtacccgttacggacgtacggttacggccggggg

SEQ ID NO: 341164 - DNA, 760 bp, Homo sapiens
  misc_feature: GZ8MTXP02JUUAF.15.56.F01.1.454.CMB.2.raw
  modified_base (229)..(229): a, c, t, g, unknown or other
  misc_feature (229)..(229): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtacantcaccagacaacgccccaatcatgtattatgagacaatgagccggcctcgtacgggtttactaagtccgtctttctcgtcggtcctaccgtaaagttctagaaccaaaccgaccccggtcccctcccgtagaacctaacttccgtcgtcggggtcctaccgaggtaccgtaggaacgggacggtaagggggttataagttttaactttacgtcggtccttggaccggtaccgtaaattaaacgtaaacggtaaaccgttcccccttaaaggtttcggttttacggttttaacccggtttttccgggggaaccggggtaaaccgggggtaaacccgaaacggttcccgttaccgggttaacccccggtttaccggttaaacgggttaccgaacccggaaccccggtaaacgggtccccgttaccccggtcccccccgttacgggttccctaacccgttcccgtttcccggttccccccggttcccctacccgttccgtccgttaaaccgttacgacccgttaggacccgggg

SEQ ID NO: 341165 - DNA, 522 bp, Homo sapiens
  misc_feature: GZ8MTXP02GVX6T.15.56.F01.1.454.CMB.2.raw
  modified_base (306)..(306): a, c, t, g, unknown or other
  misc_feature (306)..(306): n is a, c, g, or t
  modified_base (398)..(398): a, c, t, g, unknown or other
  misc_feature (398)..(398): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctcctggtaccaacatcacccaggcaaagcccccaaatcatgattatgaggacaatgagcggccctcgtaggggtttctaatcgnttctctggctccaagtctagactaacaccggcctccctgacaatctcgtgggctcaggctgagacgaggtgattatactgctgcgcatatanacgtccactgttgttacgtttcggacggagggaccaaagctacgaccgtcctaggtcacgccgaacgctcgcccctcggtacctctctcctcccaacctcccgtcgctacgtacgactacgcgg

SEQ ID NO: 341166 - DNA, 519 bp, Homo sapiens
  misc_feature: GZ8MTXP02JPXWO.15.56.F01.1.454.CMB.2.raw
  modified_base (371)..(371): a, c, t, g, unknown or other
  misc_feature (371)..(371): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaatcatgattatgaggacaatgagcggccctgagggtttcaatcgcttctctggctcaagtctgacaacacccggcctcctgacatctctgggctcaggctgaggacgagggtnattatactgctgcgcatatagacgtccagtgttgtacgtttcggcggtagggaccaagctagaccgtcgtagtcacgcccgaaggcctcgccccctggtcctacgttccgtccgttcccgccctccgtcgcttacgtcgactcggcgg

SEQ ID NO: 341167 - DNA, 674 bp, Homo sapiens
  misc_feature: GZ8MTXP02JM6CP.15.56.F01.1.454.CMB.2.raw
  modified_base (234)..(234): a, c, t, g, unknown or other
  misc_feature (234)..(234): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctaggtaccaanatcaccaggacaaacgcccccaaatcatgtattatgagaacaatgacgccggccctcgtagggtttactaatccgtctttcgtctcgggtcctaccgaaagtcgtacgaaccaaccgaccccggccctacccgtagaactactcctcgtcggtcctccgaggcgtggaacggacgggtagggtgtaatttacttacgtgtccgttggcgtactaaattacgtaacgaaaccgttccccttaaagttcggtttacgttaccggttttcgggacgggacggggtaaccaacggtccgtacggaacccgttcgtacgggttaccaccggacccggaacggtccgtaccccggtcccccgttcggtacctaccccgttaccgttccccgttccccctaacccgttccgtacccgtcgttaacggttacgacggttacggccggg

SEQ ID NO: 341168 - DNA, 525 bp, Homo sapiens
  misc_feature: GZ8MTXP02JMB25.15.56.F01.1.454.CMB.2.raw
  modified_base (386)..(386): a, c, t, g, unknown or other
  misc_feature (386)..(386): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgattatgaggacaatgaagcggcccctcgaggggtttctaatcgctttctctggctccaagtctgacacaccggcctcctgacatctctgggctcgaggctgaggacgagggtgattatacngctgcgcatatagaacgtccactgttgtactttcggcggtagggaccaagctcgaccgttctaggtcacgcccaaggctcgcccctcggtcacctctccgttcccgaacctcccgtcgcctacgtacgtaccgtgccgg

SEQ ID NO: 341169 - DNA, 606 bp, Homo sapiens
  misc_feature: GZ8MTXP02I072F.15.56.F01.1.454.CMB.2.raw
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccaantcaccagcaaacgccccaaactcatgattatgaggacaatgagcggcctcgaggggtttctaatcgtcttctctggtctccaagtctgacaacnccggcctcctgacatcctntcgggctcgaggctggacggacggagggtgaatttagtactgcgttgacgctaataagtaacgaacgtcctaacgttggtttagttaccgtttttcggggacggtacgggggaacctaaggcgtacggtaccgtcgttaaggtaccacgtacccccgaaagggtccctcccggcccccgttcggaccttacctccgttcccgtttacccccaaccccgttcccgacgtacccgttaacggtacgaaccgttcggaacgggg

SEQ ID NO: 341170 - DNA, 628 bp, Homo sapiens
  misc_feature: GZ8MTXP02G0IT2.15.56.F01.1.454.CMB.2.raw
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgtctctgtaccaanatcaccagcaaagccccaaatcatgattangagacaatgagcggccctagagggtttctaatcgcttctctggctcaagtctgacaacacccggcctcctgacatctctgggcctcgaggcctgaggacgagggtgattaatactgctgcgctaatagtaagaacgtcccaagttgtttacgtttacggttttcggacgggtaacgggtaaccctaaacggccgttacggtaaccccggttcccggttaaaggtacccgaacgtaacccccggaaacggtcccgtcccggtcccccccggttcggttacccaacccgtttcccttccggtttaacccccctaacccccgttccgtacccggtacctaacggtttaccgacgtttacgggaccgggg

SEQ ID NO: 341171 - DNA, 556 bp, Homo sapiens
  misc_feature: GZ8MTXP02JQ9UD.15.56.F01.1.454.CMB.2.raw
  modified_base (269)..(269): a, c, t, g, unknown or other
  misc_feature (269)..(269): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcaccagacaaacgccccaaatcatgatttangagacaatgagcgccctgaggggtttcaatcgcttctctggctccaagtctgacaacaccgccctcctgacatcctctgggcctcgaggtctgaacggacggtagggtntagttattacgtgctgcgcaattaanacgaacgttccaacgttgtttacgttacgttttcggcgggtacggaccgaagtcgttacgaccgttacgtaggtccacgacccaacgggtctccgccccctcggtccnctcctcttcccccncccgtcctcgtacgtacgtacgtacgcgcg

SEQ ID NO: 341172 - DNA, 506 bp, Homo sapiens
  misc_feature: GZ8MTXP02IU2Z7.15.56.F01.1.454.CMB.2.raw
  modified_base (382)..(382): a, c, t, g, unknown or other
  misc_feature (382)..(382): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagccccaaatcatgatttatgaggacaatgagcggccctcaggggtttctaatcgcttctctggctccaagtctgacaacaccggcctcctgacaatctctgggctcaggctgaggacgagggtgattatacngctgcgcatatagaagtccaatgttgtacttttggcggaggtaccaagctgaccgtctaggtcacgccaaggctcgcccctggcactctcgtcccaaccgtcctcgcctacgtacacgtgacgg

SEQ ID NO: 341173 - DNA, 552 bp, Homo sapiens
  misc_feature: GZ8MTXP02JLNRW.15.56.F01.1.454.CMB.2.raw
  modified_base (345)..(345): a, c, t, g, unknown or other
  misc_feature (345)..(345): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcaccaggcaaagccccaaatcatgattatgaggacaatgaagcggccctcaggggtttctaatcgcttctctggctccaagtctgacacaccggcctcctgacatcnctgggctcaggctgaggacgagggtgattattactgctgcgcatatagacgtccactgttagttacgtttgggacgagggtaccaagcgtacgacccgttcgaggggtaccagaccccgaaacggtccgtccgcccccgtcggtacctaccgtccgttcggttccccgcccttccgtaccgtccgtacgtacgtacgtcggaccggg

SEQ ID NO: 341174 - DNA, 547 bp, Homo sapiens
  misc_feature: GZ8MTXP02HAVJG.15.56.F01.1.454.CMB.2.raw
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
  modified_base (370)..(370): a, c, t, g, unknown or other
  misc_feature (370)..(370): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccaacntcaccagcaaacgcccccaaatcatgattangagacaatgagcggcctgtagggtttcaatcgcttctctggctccaagtctgaacacacccggcctcctgacatcctactcgggctcgaggcctgaggacgagggtnattatactgctgcgctaatataacgacgtcctacgttgtttagttacgttttcgggacgggtacgggtaccgaagtcgtacgtaccgtcgtagtacgacgacccgaacgcctccgccccgtcggtacctactcctccgtaccccaaccctcctacgtctacgtacgtacgtagccgg

SEQ ID NO: 341175 - DNA, 643 bp, Homo sapiens
  misc_feature: GZ8MTXP02IMEQV.15.56.F01.1.454.CMB.2.raw
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
tcagtctacgtagccacgaccggtgctcgatttagcagacgtctgtcgggacgtctccaccatggcctgggctctgctgctcctcactctcctcactcaggacacagggtcctgggccccagtctgccctgactcagcctgcctccgtgtctgggtctcctggacagtcgatcaccatctcctgcactggaaccagcagtgatgttggacttacacttgtctctgtaccantcacccagacaaacgccccaaatcatgtatttangagaacaagtgacgccggccctgtagggtttctaatcgtcttctctggtctaccagtcagacaccacccggccctccctagaactatccttcgtcggggcctccgaggtcctagggagggacggtagggtatattacttactggtctgcgtactaattagtaaacgacgtccctagttcggtttacgttaccggttttccggggacgggtacgggaacccgaacggtcctacggtacccgttaccggtaggtaccgaccggtacccgtaacgggtccctcccggtcccccgttccgggtaccctacccgttccgttccccggttcccccgtccccttcccgtcccgttacgttaaccggtcggtaccgtcggaccggg

SEQ ID NO: 341176 - DNA, 550 bp, Homo sapiens
  misc_feature: GZ8MTXP02IOWD6.15.56.F01.1.454.CMB.2.raw
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaatcatgattangagacatgagcgcctgaggtttctaatcgcttctctgctacagtctgacacaccgcctcctgacatctctgggcctcgagntgaggacgagggtnattatactgctgcgacatactagaacgtccctaagttggttcgttaccggtttcggacgggtacgggaaccaacggtcgtacggtaccgtcctaggtaccgtacgacccgtaacggcctcgcccccgttcgtactaccttcgtcccgttccccgccctccgtcccgcgttacgtacgacgtgacgg

SEQ ID NO: 341177 - DNA, 620 bp, Homo sapiens
  misc_feature: GZ8MTXP02HPU9U.15.56.F01.1.454.CMB.2.raw
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctcctgtaccaanatcaccaggacaaaccgccccaaatcatgattangaggacaatgagccggcctgtagggtttacaagtcgcttctcgtggcctaccaagtctagaccaaacgccccggtcctccctagaactaactccttcgtcggggtcttacccgaggaccgtaggaacgggtacgaggggtagtaagtttattacgtgtcgttggcgactaagttaagtaacggtacgtacctacgttgtttcggttacgttttccggggacgggtacgggaaccaacggtcgtacggtaccgtacgtacggtacgacgacccgaacggtccgtccgtcccccgtcggtacctacttcgttccgttcctccgtccctcctaccgacctacggtacgtacgtcgg

SEQ ID NO: 341178 - DNA, 636 bp, Homo sapiens
  misc_feature: GZ8MTXP02HGMGZ.15.56.F01.1.454.CMB.2.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttaggacttacacttgtctctgtaccanactcaccagacaacgccccaaatcatgtattatagagacaatgagccggtacctgtagggtttctaagtcgtctttcncgtcgcctaccgaacgtctacgaacctacgaccccgtccctcctagaactaacttcctacgtcgggacctaccgaggtccgtagggaacggacgggtagggtagtaatttacgttacgtgtcgtgacgactaagtaacgtaacgtaccgtacctagtttacgtttacgtttacggttttacgggaccgggtaacgggaacctaacgccgtacggtacccgtcggtacgtccgacgacccgtaacgccgtcccgtcccgtcggtcctccgttcccgttcccgttccccgtccctcccgtccgtaccgtacgtaccgtacgcggaccgg

SEQ ID NO: 341179 - DNA, 659 bp, Homo sapiens
  misc_feature: GZ8MTXP02GPBXJ.15.56.F01.1.454.CMB.2.raw
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggactacacttgtctctgtaccacntcaccagcaaacgccccaaatcatgattangagacatgagcgcctgtagggttctatcgtcttctctcggctcaagtctgaccaacacccggcctccctagactaactcctgtcggggcctccgaggcctagggacggacgtagggtgtatttagttactggcgtgcgacgtactaagtaagtaacgttcccaacgttcggtttacggtttaccggttttccggggaccggggtaacgggggtaaccctaaacggtccgttaccgggtaacccggttacccgtaaccgggtaccgtaacggaccccgtaaaacgggtcccgttaccgtcccccccggttcgggtccctaaccgttcccgttaaccgtttcccccaaccccgttccccgtaccggttacctaccggtacggtaccgttacggtaccgggg

SEQ ID NO: 341180 - DNA, 604 bp, Homo sapiens
  misc_feature: GZ8MTXP02I9QJG.15.56.F01.1.454.CMB.2.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (436)..(436): a, c, t, g, unknown or other
  misc_feature (436)..(436): n is a, c, g, or t
  modified_base (547)..(547): a, c, t, g, unknown or other
  misc_feature (547)..(547): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtnatgttgggacttacacttgtctctgtaccaanatcaccagcaaacgccccaatcatgattangagacaatgacgcggcctcgtagggtttactaacgtcgtcttcgtctcggtacctcctaagtcctacgaacaaaccgaccccggcccttaccctagaacctaactccgtcgtcggggtcctaccgaggctagggaacgggacggtagggtagtaatttagtacgtgtctggacnctagtagtaagtaactcccgtacgttaggtttacgttacggttttccgggacgggtacgggtaaccaggaccgtcggtacccgtacgtacggtacacgacccgacggtccnccgtcccccgtagtcctctcctcgtcccgccctcgtcgactacgacacgtcggacgg

SEQ ID NO: 341181 - DNA, 547 bp, Homo sapiens
  misc_feature: GZ8MTXP02JTJVF.15.56.F01.1.454.CMB.2.raw
  modified_base (214)..(214): a, c, t, g, unknown or other
  misc_feature (214)..(214): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttanaaccttgtctcctggtaccaacatcacccaggacaacgcccccaaatcatgattatgagacaatgagcggccctgagggtttcaatcgcttctctggcttccaagtctagacacaccggcctcctgacactctacgtgggcctccgaggctgacggacgagggtgattatactgctagcngatatagacgtccattgttntacgtttcggacggtacgggacaacgcgtacgacccggtctagtcgtacgacgacccgaaggccttccgcccccgttcggtcctacctccttccgttccccgaccctcctccggactaccgtaacgctacggg

SEQ ID NO: 341182 - DNA, 609 bp, Homo sapiens
  misc_feature: GZ8MTXP02JJQUS.15.56.F01.1.454.CMB.2.raw
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctcctgtaccantcaccagcaaacgccccaaatcatgattangagacaatgagcggccctgagggtttcaagtcgcttctctggctccaagtctgaacacaccggcctcctgacatctctggctaccgagctgaggacgagggtatagtttatacgtgtctgcgactaataagtaacgtaacggtaccctacgtttacgtttaggtttaccgtttttacggggaccgggttaacggggaaccgttaaacggccgttacggtacccgttaccgtacgggttacgacgaccccgtaaggccctaccggcccccgtacgggtcctacccgtccgttacccgttccccctaacccgtcccgtaccgtaccttacggtacgtacgtcggtaacgg

SEQ ID NO: 341183 - DNA, 602 bp, Homo sapiens
  misc_feature: GZ8MTXP02JMPD5.15.56.F01.1.454.CMB.2.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggacttacacttgtctctagtacanatcaccagacaacncccaacncatntattanagaganatgngcgctgtaggttcatcgtntctctgactctagtctacgacacgccgcctccagactactctacgtcgggcctcggacggcgtaggaggacgggtagggtactagttacgttacgtgtcgtcggacgtacctaaagttaacgaacggttaaccctaccgttagtttacggtttacggtttacggtttaccgggaacgggtaacgggaacctaacgtcgtaccgaccggttacgtacggaccgacgaccggtacggcccgtcccggtaccccgtcggtctaccgttccctccgtccccgtccgtcccgtcgtacgtacggacgtacggcgcggg

SEQ ID NO: 341184 - DNA, 685 bp, Homo sapiens
  misc_feature: GZ8MTXP02HABAD.15.56.F01.1.454.CMB.2.raw
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (634)..(634): a, c, t, g, unknown or other
  misc_feature (634)..(634): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacacttgtctctgtaccaantcaccaggacaaacgccccaaatcatgattangagacatgacgccggcctcgtagggtttactaactcgtcttcgtcgtcggcctaccgaagtctagaaacctaacgccccggtccctaccgtagaactactcttcgtcgggtcctcgaggtctaggacgggacggtaggggtatagttattacgtcgctcgacgtactaaagttaacgtaacggtaccgtacccgtaagtttcggtttaccgtttaacggttttcgggggaccgggtaacgggaaaccgtacgtacgttaccggtaccggttaccgttacggaccgaaccgaccccggttaaacgggcccgttaccccggacccccgtttcgggaaccccttacccgttcccgttccccggtttaacccccnccccgttcccgtaccgtaccgttaacggtaccgacggttacggtaccgggg

SEQ ID NO: 341185 - DNA, 550 bp, Homo sapiens
  misc_feature: GZ8MTXP02H5A0S.15.56.F01.1.454.CMB.2.raw
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (516)..(516): a, c, t, g, unknown or other
  misc_feature (516)..(516): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccagcagtgatgttggacttacaacttgtctctgtaccaanatcaccagacaacgccccaaatcatgattangaggacaatgagcgccctgtagggttntaagtcgcttcgtntcggctacaagtctacgacacacccggcctaccngacatctcgngggctcgaggtcnggaggacgtaggtagtattatagtgcgngacgctaatagaacgtacgtcctaagttgtttacgttacgttttcgggacggtaggacgaagcgtacgaccgtcgtaggtcacgtacccgacgccgtaccgccctacggctacgtcctcggtaccccnccgtccgtacgtaccgtacgtactcgtacgcggg

SEQ ID NO: 341186 - DNA, 680 bp, Homo sapiens
  misc_feature: GZ8MTXP02JFAOE.15.56.F01.1.454.CMB.2.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (387)..(387): a, c, t, g, unknown or other
  misc_feature (387)..(387): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgacctcaacctgcctccgtgtctgggtctcctggacagtcgatcaccatctcctgcactggaaccagcagtgatgttggacttacacttgtctctgtaccacntcaccaggcaaacgccccaaancatgatttangaggacatgagcggcctagaggggtttctaagtcgtcttctcgtcggctacgatctcgacaacgaccgcccctaccgtgactaactctcgtgggcctcacggtctggacggaacggtagggtntaaacgtttaagttaccgtgtaccgtggccgtactaagtaacgtaacgtaacggtacccctaaggtttacgttcgtttaacggtttccggggacggaacggtaaccgtaacgccgtacggtacccggtacgttaacggtccgaccggtacccgaacgggtaccccgtttcccggacccccggtttccggggtaaccctacccttttcccgtacccggttttaccccccgaaccttcccggtacgtacccggttaaaccgtaccgtacggttaacggggtaccggtacccgggg

SEQ ID NO: 341187 - DNA, 566 bp, Homo sapiens
  misc_feature: GZ8MTXP02GJMWD.15.56.F01.1.454.CMB.2.raw
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaacgccccaaactcatgatttatgaggacaatgagcggccctgaggggtttactaatcgcttcnctggctcaagtctagacaacgaccgccctcctgacaagtcctctgggctccgaggctgaggacggagggtgatttatactgctagcgctagtaatanaaacgtcccacgttgttcgttacgtttcgggacggtacgggaccaagtctaggtaaccgtccgtagtccagcccgaaggcctcggtccccctacgggtccaccgttccgtcccttccccaaccccttcctacgcctaacgtacgacgttcggaccgg

SEQ ID NO: 341188 - DNA, 534 bp, Homo sapiens
  misc_feature: GZ8MTXP02JFI8N.15.56.F01.1.454.CMB.2.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgctctgtaccantcaccagcaaagccccaaatcatgattatgaggacaatgagcggccctgaggggtttcaatcgcttctcgtggctccaagtctanacaacaccggccctccctgacatctctggctcaggctgaggacgagggtcattatactgctgcncatacgtagaaacgtccctagttcgttgttaacgttttcggacgggagggaacccaaaggtctacggaccgttcgtacggtcaacgcccgaaagccgtcgcccccgtggacctactcgtcgttccccgccttccacgctacgtacacgtgaccgg

SEQ ID NO: 341189 - DNA, 616 bp, Homo sapiens
  misc_feature: GZ8MTXP02G95RR.15.56.F01.1.454.CMB.2.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccaanatcaccagacaaaacgcccccaaancatgattangagacaangagcgcctgagggtttacaatcgcttctcgtgctacaagttcngaacaacacccggcctccgtnaacaatcncgtggcncgagctgaggacgtagggtanattaattacgngcgtgacgacaataagtaacgacgtaccgtacgtttgttacggtttacggtttacgggacgggaacggtaacgaacgtcgtacggtacccgtaccgtaacggtaccgacgacccgtaacggtcccgtccccgtcccccggtaccggttaccctaccgttcccgttccccgtcccccgtccccgttacccttaccgtaccgtaaccggtaaccgaaccggtacggtaccggg

SEQ ID NO: 341190 - DNA, 561 bp, Homo sapiens
  misc_feature: GZ8MTXP02FL2OE.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctgtaccaacatcacccaggcaaacgcccccaaatcatgatttatgagacaatgagcgcctgagggtttctaatcgcttctctggctccgaagtctagacacacccggtccctccctagacaatcctcgtgggctccgagctgaggacgagggtgtattattactgctgcgcatatagacgtccctagttgttgttacgtttcggcggacgggacagcgtacgaccgttcgtagtcacgtccgaacggctaccggcccccttcggtcctaccgtccgttcccgttaccccctaacccgttcccgtccgtaccgttaccgtacgacgtacggacggg

SEQ ID NO: 341191 - DNA, 697 bp, Homo sapiens
  misc_feature: GZ8MTXP02FLRU4.15.56.F01.1.454.CMB.2.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttggacttacaacttgtctctgtaccacatcaccagcaacgccccaaancatgattangagacatgacgcgcctgtaggtttacatcgtcttctcgtcgctacctaagtctacgaaaccaacgtaccccggtcccttacccgtagtaaacctaacttccgtccgttccggggcccttaccgaggggtaccgttagggaacggggaaccggtaagggggttagttaattttaacgtttaacgtcgtcgttggacccgactaagttaaacgtaaacgggtaaaccttcccccgtaaaggttttcggttttaacggtttaccgggttttaccgggggacgggtaacggggaacctaacggtccgtaccgtacccgtaccgttacggaccgtaccgacccgaaacgggtcccttccggtcccccgttacggtccctaccgttccctccgtttaccccctcccctccgtccgtaccgttacgacgtacgacggccggg

SEQ ID NO: 341192 - DNA, 642 bp, Homo sapiens
  misc_feature: GZ8MTXP02JK0J4.15.56.F01.1.454.CMB.2.raw
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
  modified_base (591)..(591): a, c, t, g, unknown or other
  misc_feature (591)..(591): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaccttgctctgtaccanatcaccagcaaacgccccaaatcatgtattanagagacaatggacgggccctgtagggtttcaagtcgtctttctcgtcgtacctacgtacgtctacgaccaaaccgccggtaccccctccgtacaactaacgttccgtcggtcgggtcctaaccggcggtacgtacggaacgggagggtagggtcttaaagttagttcgtcgtgtcgcgtatagtagtaacgtactacccgtagtttacgttcgtttacggtttacgggaggaacggtaccgaaacgtcgttacgaccgttacgtacgtacgaccgacgacggtcccgtacccggtcccgtacgtcctaccttccgtccccttaaccccncccgttccgtaccgtaaccgttacggtaacgtcggttacgggcgtccgggg

SEQ ID NO: 341193 - DNA, 642 bp, Homo sapiens
  misc_feature: GZ8MTXP02FUTIX.15.56.F01.1.454.CMB.2.raw
  modified_base (231)..(231): a, c, t, g, unknown or other
  misc_feature (231)..(231): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccanatcaccagcaaacgccccaaatcatgtattatgagacaatgagcgcctgtagggtttctaatcgcttctctggctccaagtctagacaacgacccgccctcctagactactcctcgtcgggcctaccgaggtccgtagggaacgggacgggtagggttagtaagtttaacttacgtgcgtgcgactaagtaacgtaacgtaaaccgtcccgtaaacgttcggtttacggtttaaccggtttcgggacgggtaacgggaacctaacgtccgtacgtacccgtacgtacggtaccgacgaccccgtaacggtcccgtccgtcccccgttcggttaccctaccttccgttcccgttaccccctaaccccgttcccgtaccgtaccgtaaccggtacgtaaccgtcggtaccggg

SEQ ID NO: 341194 - DNA, 525 bp, Homo sapiens
  misc_feature: GZ8MTXP02GCVUD.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaaacgcccccaaatcatgattatgaggacaatgagccggcctcgaggggtttcaatcgcttctctggctccaagtctgacaacacccggcctccctgacaatctctgggctccaggctgaggacgagggtgatttattactgctgcgacataatagaaacgtcccacttgttgtacgttttcggcggagggtaccaagctggaccgtccaggtcacgcccaacgctcgcccctcggtcactctcgtcccaacctcctcgctacgtacgactgacggg

SEQ ID NO: 341195 - DNA, 650 bp, Homo sapiens
  misc_feature: GZ8MTXP02IQYDT.15.56.F01.1.454.CMB.2.raw
  modified_base (262)..(262): a, c, t, g, unknown or other
  misc_feature (262)..(262): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggacttacaaccttgtctcctagtaccaacatcaccaggacaaaacgccccaaancatacgtattatgagaacatgacgcgccctagtacgggttactaagtcgtcttctctcggtctaccaagtcctagaaccaaccgacccggtccctccctagaacctaatccgtcgtcgggtctccgacgcgtagaggacggtagggtattattacgttacgtgcttcgacgtactaaagttaacgaacgtaacgtcccttaagttgttttacgttacggttttacgggacgggtaacggaccgtaacgtccgtacggtaccgtacgtacggtaccgacgtacccgtaacgtcccgtaccgtccccgttaccgttccgttaccctttaccgtccccttacccgtccgttccgaccgtttaccggaacgtccggtacggacggttccggg

SEQ ID NO: 341196 - DNA, 659 bp, Homo sapiens
  misc_feature: GZ8MTXP02GMJNI.15.56.F01.1.454.CMB.2.raw
  modified_base (233)..(233): a, c, t, g, unknown or other
  misc_feature (233)..(233): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgtggacttacaacttgtctcctggtaccaanatccaccagaccaaacgccccaaactcatgtattatgagacaatgagcggccctgtagggtttacaatcgcttctcgtggcctacgaagtctagaacaacgaccccgtcctccctagactaactctacgtcgggctccgaggccgtggaacggacggtaggtagtatttaacttacgtcgtcttcgacgtactaagtaagtaacgtaaaccgtacccgtacgttacggtttcgttacccgggttttacgggaccgggtaacggggaaccgaaaccggtccgtaccggtaccccggttaccgttacggaccgtacgaccccggaacggtcccgtcccgtcccccgtccggtacctacccgttcccttcccggttcccccgtccccttcccgtaccgtcccgtaacgttaacgacgtcggaaccgggg

SEQ ID NO: 341197 - DNA, 715 bp, Homo sapiens
  misc_feature: GZ8MTXP02IQG1X.15.56.F01.1.454.CMB.2.raw
  modified_base (240)..(241): a, c, t, g, unknown or other
  misc_feature (240)..(241): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (492)..(492): a, c, t, g, unknown or other
  misc_feature (492)..(492): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgcccctgactcagcctgcctccgtgtctgggtctcctggacagtcgatcaccatctcctgcagttaggaaccaggcagtgatggttgggaccttacaccttgtcctcctgtaccanncaccagcaacgccccaaatcatntattangagaacagtgacgccgcctcggtaggtttactaagtcgtcttcgtcgtcggtccttaccgtacgtctacggaaaccaaccggaccccggtccccctacccgtagtaaccgtaacttccctccggtcggggtccctcccggaagggtcccgttagggggaaacggggtaacggggtagggggtttacgtaattttaaaccgttacgtcgtccgtcgtacccgntaaagttaacgtaacggtaacctcccgttaagtttcgtttacggtttaccggtttaccggggacgggtacggggaaccctaacgtccgtaccggtaccgttaaccgtcgggtaccacggaccccgtaacgggtccctcccggtacccccgtcgttacctccctttcctcccgtttccccaaccccgtcgttaccgtcgttaacggactacggttcggaccggg

SEQ ID NO: 341198 - DNA, 670 bp, Homo sapiens
  misc_feature: GZ8MTXP02HX6FP.15.56.F01.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaaccttgtctctgtaccaacatcaccagacaaacgccccaaatcatgattangagacatgagcgccngtaggttctatcgtnttctgtggctctaagtctacgaacacgacccggtcctacccgtgaacctattcctcgtcggggctaccgacggtccgtagggaacgggtacgtagggttacgtaaagtttacgttaacgtcggtcgttacggtacgtaaccgttaaattaaacgtaacggttaaaaccgttcccccgtaaagttttcgggttttaaacgttttaccggtttttacggggacggggtaaaccgggtaacccgtaaaggtccgtaacggttacccggtacgttacggtaccgacgtacccgaacggtcgtacccgtccccgttcggtacctccgttcgtacccgttcccgcccttccgtccgtacgtaccgtactcgtaacggccgg

SEQ ID NO: 341199 - DNA, 622 bp, Homo sapiens
  misc_feature: GZ8MTXP02HXMU9.15.56.F01.1.454.CMB.2.raw
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccacatcaccagcaaacgccccaaatcatgattatgagacaatgagcgcctgtagggtttcaatcgcttctctggctcaagtctagacaacacccggccctccctagaactaatcctacgtcggggccttccgaggtcctagggacggacgtaggggtgtattattacgtgtctgacgctaataagtaacgaacgtcccctaatttggtttacgtttaccggtttttcggggaccgggtaagggtaacccaaaggtccgttacggaacccgttacgtacggtacgaaccgtacccgaaacgggtcccgttaccgccccccgttcggtaccctacccgttccgttcccgttccccgccccttccgtaccgtctaacggtacgacgttcggaccggg

SEQ ID NO: 341200 - DNA, 706 bp, Homo sapiens
  misc_feature: GZ8MTXP02FNKN0.15.56.F01.1.454.CMB.2.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttacggacttacaccttgtcctcgtacgtaccaacactaccacccgagaccaaaaccgcccccaaactcatagtaattanagaacganaagtgacggccggtacctggtacgggtttactacgtcgtcttcgtcgtcggctaccgtaagtcctacgaaccaaccgtaccccggtccccttaccagtaactacttccgtcgtcgggcctacggacggtacgtagggacgggtacggtagggtttataactttacgttacgtgcgttagaccgtataataacgtacgtaaaccgtcccgttagtttacggttcggtttacgggttcgggacgggtaacgggtaacctaacgtccgtacggtacccgttacgtacggaccgaccggtaaccgacggtcccgtcccgtaccccggttacggtacccttccggttccgttccccggttcccccgtccgttccccgtacggttaccgtaaccggttacggaaccggtcggacccgggg

SEQ ID NO: 341201 - DNA, 632 bp, Homo sapiens
  misc_feature: GZ8MTXP02HLAQS.15.56.F01.1.454.CMB.2.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttggacttacaccttgtctctgtaccantccaccagacaacgccccaancatgtattangagacaatgagccgcctcgtagggtttctaatcgcttcacgtgcctccaagtcctagacctaacgaccccggtccctccgtagacaactctcgtcgggcctacgacggctaggacgggacggtagggtagtaattagttacgtgacgtgcgactaataagtaaacgtacgtcccttacgttcgtttgttacgtttttacgggacggtaacgggtaccgaacgccgtacggtacccgttaccgtacggtaccgtacgaccccgaacggtccgtccggtcccccgtccggttacccgtaccgttaccgttacccgttacccccaaccccgttcccgtacccgtccgtaaccgtacgtacgttacggccgggg

SEQ ID NO: 341202 - DNA, 686 bp, Homo sapiens
  misc_feature: GZ8MTXP02I2YZ8.15.56.F01.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggacttacacttgtctctgtaccacatcaccagacaaacgacccaancatntattanagagacagtgacgccgcctagtacggttctacgtcgtcttctcgtcgctacacgtctcgaacaccnccccgccctaccgtacaaacctctaccgtcgtcgggtcctccgaggcgtagggaacgggtacgggtagggtagttaagtttaacgtcgtacggtcgtacgtacgaattaattaaacgtaaaccggtaccttaccccgttagtttaggtttaccggtttacggttttaccgggaccgggtaacgggaaccgtaaccggtccgttacgtcccggttaaaccgtcgtaacccggaccgtaacccgtaacggtccccgttcccggcccccggttacggtcccttaccgttcccgttccccgttccccgtccccgttaccgtccggttaacgtaccggtaccgtcgggtacggtaccgggg

SEQ ID NO: 341203 - DNA, 715 bp, Homo sapiens
  misc_feature: GZ8MTXP02IO2DK.15.56.F01.1.454.CMB.2.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
tcagtctacgtagccacgaccggtgctcgatttagcagacgtctgtcgggacgtctccaccatggcctgggctctgctgctcctcactctcctcactcaggacacagggtcctgggccccagtctgccctgactcagcctgcctccgtgtctgggtctcctggacagtcgatcaccatctcctgcacgtggaaccngcagtgattgttaggtacttaactacttgtcctctacggtaccaacntaccaaccccgaggaacaaaacccgccccaaactcatagatttagngaacgacatagaccgccggtccctggttacgggtttactaagtccgtcttcgtcgtcgtcctaccgacgttctagaaccaacgtaccccgtccctccgtagtaacctactcctcggttcgggcccttaccgggaggtccgtaggggtaacgggacgggtagggttattaagtttaccgttagtccggtgttacgggacctaacgttaattaacggtaaaacgtacccgttacccgtaacgtttcgggttttacctttaccggggtttaccgggacggggtacccgggtaaaccgagtccggtaaaccgttcgtaaccgttacggctacgaccgtacggtccctacccggtccccgttcgaccttacgtcccgttcccgttaacccctccgtccgtacgtacgtacgtaccgtacgtacgtaccggg

SEQ ID NO: 341204 - DNA, 715 bp, Homo sapiens
  misc_feature: GZ8MTXP02IXOW7.15.56.F01.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggacttacaacttgtctctgtaccaacatcacccaggacaaacgcccccaaatcatgattangaganaatgagcggccctgtagggtttctaagtccgtcttctcgtcggctaccaagtctagaacaacgacccgccctcctagactaatcgtctcgggtctaccgaggctagggacgggaacggtagggtgtacgtttaacttacgtagtacgtgtacggtactaagttaacgtaaggtaaaccgttacccgttaacgtttaggttttaccggtttaaaccgtttttcggggacccgggggttaaagggggtaaccccaaaagggttcccgtaccgggtaacccggttaccgtaacggttccgaaaccggacccccggtaaggcccgtttaccccgccccccggttaaccgggtacctaaccccgttccgttaccccgtttaccccccgtaacccccgttccgtaccgtaacccgttaccggtaacggtaccgttacggggaacccggg

SEQ ID NO: 341205 - DNA, 729 bp, Homo sapiens
  misc_feature: GZ8MTXP02H9OH0.15.56.F01.1.454.CMB.2.raw
  modified_base (213)..(213): a, c, t, g, unknown or other
  misc_feature (213)..(213): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
tcagtctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaccagcagtgatgttgggacttanaaccttgtctcctaggtaccaactatccacccaggcaaacgcccccaaatcatgatttangagacaatgagcgccctcgtacgggtttctaancgtcttctctggctacaactntcgtacaacgaccggccctcccagaactaatccgtcttgggcttccgacggtctacggacgggtacgagggttacgtatttaacgtttacgtagtacgtacgtacgtctaaaccgttagtaaaccgtaaaccgggttacccccttaaacccggtttggtttaaccggtttacccgggtttttttacggggacccggggttaaacgggggaaccccgtaaaacggttacccgtacggtaccccggttaccgtttaacgggaccgttaaccggacccccgaaacggtcccgtacccggtaccccccgtttacgggaccctaccgttcgttaaccccggtttccccctaaccccgttaccccgttccgacctttaaccggttaacgacccggtttagacccgggg

SEQ ID NO: 341206 - DNA, 527 bp, Homo sapiens
  misc_feature: GZ8MTXP01APSYD.38.3.A03.1.454.CMB.2.raw
  modified_base (314)..(314): a, c, t, g, unknown or other
  misc_feature (314)..(314): n is a, c, g, or t
  modified_base (519)..(519): a, c, t, g, unknown or other
  misc_feature (519)..(519): n is a, c, g, or t
tcagtcgatcacgtcacgaccggtgctcgatttagagagcgtcacaggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaaggccccaaactcataatttatgacgtcagtagtcggccctcgaggggtttcngatcgcttctcaggcctccaagtctggcaaacacggcctccctgaccatctctgggctccaggttgaggacgagctagactattattgcgcctcacagtggaatcgagggtagggtttcggcggtagggaccaaagtcgaccgtccgtaggtcacgcccgaaggccgtcgccccttcggttcacgtctcgtcccaccctccttcncgttcgcg

SEQ ID NO: 341207 - DNA, 455 bp, Homo sapiens
  misc_feature: GZ8MTXP01ARSDK.38.3.A03.1.454.CMB.2.raw
  modified_base (437)..(437): a, c, t, g, unknown or other
  misc_feature (437)..(437): n is a, c, g, or t
  modified_base (446)..(455): a, c, t, g, unknown or other
  misc_feature (446)..(455): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcgggggattcaaagcatttgatagttggggccaagggaccatggtcaccgtctcttcagcctccaccaagggccccatcggtccttccccctggccacccctcctccaagacgccacccctcgtgggggcacgacgccggccctgggcctgcccgtggtacaagggacttactccacgtgatcgactgaggcgggctggcaaggcncgatagggnnnnnnnnnn

SEQ ID NO: 341208 - DNA, 435 bp, Homo sapiens
  misc_feature: GZ8MTXP01DFXV7.38.3.A03.1.454.CMB.2.raw
  modified_base (427)..(435): a, c, t, g, unknown or other
  misc_feature (427)..(435): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcgggggattcaaagcattgatattgggcaagggaccatggtcaccgtctcttcagcctccaccaagggcccatcggtcttccccctggcaccctcctccaagagcacccctctgggggcacacgccggccctggggctgcctggtcaaggactacttccacgtgatcgactgagcgggctggcaaggcgcataggnnnnnnnnn

SEQ ID NO: 341209 - DNA, 434 bp, Homo sapiens
  misc_feature: GZ8MTXP01BTBR6.38.3.A03.1.454.CMB.2.raw
  modified_base (427)..(434): a, c, t, g, unknown or other
  misc_feature (427)..(434): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcatttgatatttggggccaagggaccatggtcaccgtctcttcagcctccaccaagggcccatcggtcttccccctggcaccctcctccaagagcacccctctgggggcacagcggccctgggctgcctggtcaaggctacttccacgtgatcgactgagcgggctgggcaaggcgcataggnnnnnnnn

SEQ ID NO: 341210 - DNA, 431 bp, Homo sapiens
  misc_feature: GZ8MTXP01AM4WF.38.3.A03.1.454.CMB.2.raw
  modified_base (423)..(431): a, c, t, g, unknown or other
  misc_feature (423)..(431): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgttctgcacatgagcggcctgcgagtcgaggacacggctgtctattattgtacgagagatcggggattcaaagcatttgatatttggggccaagggaccatggtcaccgtctcttcagcctccaccaagggcccatcggtctccccctggcaccctcctccaagagcacccctctgggggcacagcggccctgggctgcctggtcaagactactcacgtgatcgactgagcgggctggcaaggcgcatagggnnnnnnnnn

SEQ ID NO: 341211 - DNA, 522 bp, Homo sapiens
  misc_feature: GZ8MTXP01DKYDS.38.3.A03.1.454.CMB.2.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
  modified_base (515)..(515): a, c, t, g, unknown or other
  misc_feature (515)..(515): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccanatcacccagacaagcccccaaatcataatttangacgtcagtagtcggccctcaggggtttctgatcgcttctcaggcctccaagtctggcaaacacggccctccctgaccatctctgggctccaggttgagggacgaggctgactattattgcgctcacagtaggaatcgagggtagggttttcggcggtaggaccaagtgaccgtctaggtcagcccaaggctcgccccttcggttcactctcgtcccgccctccttctaacgngtaaccg

SEQ ID NO: 341212 - DNA, 518 bp, Homo sapiens
  misc_feature: GZ8MTXP01DJE3S.38.3.A03.1.454.CMB.2.raw
  modified_base (405)..(405): a, c, t, g, unknown or other
  misc_feature (405)..(405): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggccccaaactcataatttatgacgtcagtagtcggccctcgaggggtttctgatcgcttctcagcctcagtctgcaaacacgcctcctcgaccatctcgtgggctccgaggttgaggacgagctagacttattatgcgctnacagtggaatcgaggtgggtttcggcggtagggacaagtgaccgtcaggtcacgccaaggctcgccccttcggttcactctcgttccccaccctccttctaacgttcgtaacg

SEQ ID NO: 341213 - DNA, 440 bp, Homo sapiens
  misc_feature: GZ8MTXP01BL2QG.38.3.A03.1.454.CMB.2.raw
  modified_base (428)..(440): a, c, t, g, unknown or other
  misc_feature (428)..(440): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcattgatagttgggcaagggaccatggtcaccgtctcttcagcctccaccaagggcccatcggtcttccccctggcaccctcctccaagacgcacccctcgtgggggcacacgccggccctgggctgcctggtcaaggactactccagtgatcgactgagcgggctggcaaggcgacagtaggnnnnnnnnnnnnn

SEQ ID NO: 341214 - DNA, 502 bp, Homo sapiens
  misc_feature: GZ8MTXP01CIVDR.38.3.A03.1.454.CMB.2.raw
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagtcgatcacgtcacgaccggtgctcgatttagagagcgtcacaggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctgtaccaantcaccagacaagccccaatcataattangacgtcagtagtcggccctgaggggtttctgatcgcttcncaggccctccaagtctggcaaacncggcctccctgacccatctcgtgggctccgaggttgaggacgaggctgactattatgcgctcacagtggaatcgagggtaggtttcggnggtaggaccgaaagtcgacgtccagggtcagccaagctcgcccttcgcnctctcgtcccncctcacncgttgcg

SEQ ID NO: 341215 - DNA, 521 bp, Homo sapiens
  misc_feature: GZ8MTXP01D2JWF.38.3.A03.1.454.CMB.2.raw
  modified_base (279)..(279): a, c, t, g, unknown or other
  misc_feature (279)..(279): n is a, c, g, or t
  modified_base (502)..(502): a, c, t, g, unknown or other
  misc_feature (502)..(502): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctgtacaacatcaccagacaacgccccaaatcaataattangacgtcagtagtcgccctgtaggggtttctgatcgcttctcaggcctcaagtctggacaaacacggccctcctgaccatctcgtgggctccgaggttgaggacgaggctagacttattatgcgcctcacagtgaatcgagggtagggtttcggcggtaggaaccaaaggtcgaccgtcaggtcacgccgaaggcctcgccccttcggttcacctctcgtcccncctccttctaacgttgaac

SEQ ID NO: 341216 - DNA, 426 bp, Homo sapiens
  misc_feature: GZ8MTXP01A0PB7.38.3.A03.1.454.CMB.2.raw
  modified_base (332)..(332): a, c, t, g, unknown or other
  misc_feature (332)..(332): n is a, c, g, or t
  modified_base (341)..(341): a, c, t, g, unknown or other
  misc_feature (341)..(341): n is a, c, g, or t
  modified_base (421)..(426): a, c, t, g, unknown or other
  misc_feature (421)..(426): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcgggggattcaaagcatttgatattggggccaagggaccatggtcaccgtctcttcagcctccaccaagggcccatcggtctcccctgcacctctccaagngcacccctntgggggcacagcgggccctgggctgcctggtcaaggctacttccacgtgatcgactgagcgggctggcaagcgcataggnnnnnn

SEQ ID NO: 341217 - DNA, 454 bp, Homo sapiens
  misc_feature: GZ8MTXP01EF9WT.38.3.A03.1.454.CMB.2.raw
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (446)..(454): a, c, t, g, unknown or other
  misc_feature (446)..(454): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcattgatagtttgggcaagggaccatggtcaccgtctcttcagcctccaccaaggcccatcggtccttccccctggccacccctcctaccaagacgccacccctcgtgggggcacacggccggccctggggctgccctggtacaagggactaccttccagtgactcgactgacggcgggtcngggcaagggccganataggnnnnnnnnn

SEQ ID NO: 341218 - DNA, 532 bp, Homo sapiens
  misc_feature: GZ8MTXP01EMV83.38.3.A03.1.454.CMB.2.raw
  modified_base (301)..(301): a, c, t, g, unknown or other
  misc_feature (301)..(301): n is a, c, g, or t
  modified_base (410)..(410): a, c, t, g, unknown or other
  misc_feature (410)..(410): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctggtacaacatcaccagacaacgccccaaactcataatttatgacgtcagtagtcggccctnaggggtttctgatcgcttctcaggcctcaagtctggacaaacacggccctcctgacccatctcgtcgggctccgaggttgaggacgaggctagacttattatgcgcctnacagtgaatcgagggtagggtttcggcgggtacggaccgaaaggtcgaccgtcgtaggtcacgccgaacggcgtcgccccttcggttcactctcgtccccgcctccttctaacgttgtaacg

SEQ ID NO: 341219 - DNA, 538 bp, Homo sapiens
  misc_feature: GZ8MTXP01BCKDA.38.3.A03.1.454.CMB.2.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtaacttataaccatgtctcctggtaccaacatcacccagacaaggcccccaaaatcataaatttangacgtcagtagtcggccctnagggggttttcngatcgtcttcacgagcctacaagtctgacaaacacgcctcctacacactctctcgctcagtagagagagntatatatatgcgctacacagtagaagtacgtaggtaggttcggtacggacggaacgaaacgtacgtacgtaccgtacgtaacgacgaccgaacgacgtcgtcccgttccgttcactctcgtcccgtccctcccttcctcgttcgtaacg

SEQ ID NO: 341220 - DNA, 547 bp, Homo sapiens
  misc_feature: GZ8MTXP01E1LKO.38.3.A03.1.454.CMB.2.raw
  modified_base (370)..(370): a, c, t, g, unknown or other
  misc_feature (370)..(370): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctgtaccaacatcaccagacaacgccccaaactcataattatgacgtcagtagtcggcctcgtaggggtttctgatcgcttctcaggccctaccaagtctggcaaaaccacggcctccctgacccatctcgngggcctcctaggttcgagggacgaggctagacttattattcgcgctacacgagtggtaatcgagggttagggtttcggacggtagggaacctaaaggtcgaccgtcctaagggtcacggcccaaggcctcgcccccaggttccactctcgttcccgccctccgttcaacgttgaacg

SEQ ID NO: 341221 - DNA, 728 bp, Homo sapiens
  misc_feature: GZ8MTXP01CL65G.38.3.A03.1.454.CMB.2.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (278)..(278): a, c, t, g, unknown or other
  misc_feature (278)..(278): n is a, c, g, or t
tcagtcgatcacgtcacgaccggtgctcgatttagagagcgtcacaggggggcagcgctctcaggacatctccaccatggcctgggctctgctgctcctcaccctcctcactcagggcacagggtcctgggcccaatctgccctgactcagcctgcctccgtgtctgggtctcctggacagtcggtcnccatctcctgcactgggaaccngcagtgactattggtacttataaccatgtctctgtacacatcaccagacacgaccccaatcatattangacgtcagtagtccggcctcgtagggtttctgatcgtcttctcgacgtcccctacaagtcgtaggaccaaaccaccggtccctccctcgacctactcgtacgtcgggccttcccgtaggttcggaacggtacggaggtacctaggttaaccttagttaacgttcggaccgtaccctacgtaaccgtaagggtacggtaaacggttcggttaacggggggttacgggggtttttaccgggggaccgggggtaaacgggggtaaacccgtaaaaggggttccgggtaaccccggttccggtaaacggggttaacccggaaacggacccccgggtaaacggggccccgtttaacccgggtccccccgttacggggttcccttaacccgtttcccgttacccgtttaacccccgtaccccttacccgttacccgtaacccggttcgtaacccgg

SEQ ID NO: 341222 - DNA, 503 bp, Homo sapiens
  misc_feature: GZ8MTXP01B7EJP.38.3.A03.1.454.CMB.2.raw
  modified_base (484)..(503): a, c, t, g, unknown or other
  misc_feature (484)..(503): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagctatttgattagtttggggaccaaagggaccagtggtcaccgtctcttcagccctccaccgaacgggccccatccggtccttcccccgtcggcccacccctccctaccaacgacgcctaccccgtcgtgggggcacgacggcccggccccgtggggcctcggcccgttgggtaccaagggtacctaccttccacgtgaactccgactggacggcgggctcgggcgaaggcgacagtaggnnnnnnnnnnnnnnnnnnnn

SEQ ID NO: 341223 - DNA, 534 bp, Homo sapiens
  misc_feature: GZ8MTXP01BL1AE.38.3.A03.1.454.CMB.2.raw
  modified_base (284)..(284): a, c, t, g, unknown or other
  misc_feature (284)..(284): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctggtaccaacatcacccagacaacggccccaaactcataatttangacgtcagtagtcggccctcgagggggtttctgatcgtcttctcaggcctccaagtctggcaaacncggcctccctgaccatctcgtgggctccgaggttgaggacgaggctagacttattattgcgctcacagtggaatcgagggtagggtttcggnggacgggacngggtcgaccgtctaagtcacgcccgaaggccgtcgtccccttggttccactcctcgtccccacctccttctaacgttcgaac

SEQ ID NO: 341224 - DNA, 691 bp, Homo sapiens
  misc_feature: GZ8MTXP01C7O07.38.3.A03.1.454.CMB.2.raw
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctccgtggacagtcggtcgccatctcctgcactggaaccngcagtgactattggtacttanaaccatcgtctcctgtaccaanatcaccagacaacgaccccaaactcataattatgacgtcagtacgtccggccctcgtagggggtttcctgactcgtcttctcgacggtccctccgaagtctagggaccaaaaccgaccgggcccttccctcgaccctatcctcgtgggcctccgtagggttggacggacggaggtactagtacttatttagtcgccgtcctacacgtagtacggtaagttaccggtaagggtacggggttttaccggacggggtaacggtaaacccggtaaacggtccggtaacccggttaccggtaacggtaacccgtaacggaccccggtaaacgggttcccgtcccggtccccccggttacccggttcccgttaacccgtttccccgttacccggttcccccttaacccccgtcccgttacccgtaacccggttcggttaacccgg

SEQ ID NO: 341225 - DNA, 692 bp, Homo sapiens
  misc_feature: GZ8MTXP01A8B7U.38.3.A03.1.454.CMB.2.raw
  modified_base (249)..(249): a, c, t, g, unknown or other
  misc_feature (249)..(249): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactattggtacttataaccatgtctctgtaccaanatcaccagacaacgccccaaatcataattangacgtcagtacgtcggccctgacgggtttcngtactcgtcttctcaggtccctaccaagtctggaccaaaacgcccggccctccctagaccctacgtccgtcgtcggggtacctaccgtaagggttggaacgggacggaacgggtctacggtaacttaattaacgttcgcccgtacctacgaaccgtagggttacgggtaaacgttaccggtaagggggttaacggggttttccgggggaccggggttaaacggggaaaacccgtaaaaggttccggtacccggttaaccgtaaggggtaaccaacggaccccgtaaacgggcccgtcccggtaccccccgttcgggttacccttaccgttccccgtcccgttccccggtccccttccgttccgtaaccgttcgtaacccgg

SEQ ID NO: 341226 - DNA, 493 bp, Homo sapiens
  misc_feature: GZ8MTXP01CM582.38.3.A03.1.454.CMB.2.raw
  modified_base (481)..(493): a, c, t, g, unknown or other
  misc_feature (481)..(493): n is a, c, g, or t
tcagtcgatcacgtcacgaccggtgctcgatttagagagcgtcacagggagttcttggcattgtctctggagtgggtggcccacatcgacccaggtgaattgagagatcctatgtggactctgtggagggctggttcaccatctccagagacaatgccaagaactccctgtttctgcacatgagcggcctgcgagtcgaggacacggctgtctattattgtacgagagagtcgggggattacaaagcatttgattagtttggggaccaagggaccagtggtcaccgtctcttcacgccctccaccgaacgggccccagtccggtccttcccccgtggccacccctcctaccaagcgcccacctcgtcgggggccacgacggcccggcccgtgggcctcggcccgtgggtaccaaacgggtaccttaccttcccgaggtcgtactcgacgtggacggcgggcgtggcgaaggcgacagtagnnnnnnnnnnnnn

SEQ ID NO: 341227 - DNA, 478 bp, Homo sapiens
  misc_feature: GZ8MTXP01CP217.38.3.A03.1.454.CMB.2.raw
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (455)..(455): a, c, t, g, unknown or other
  misc_feature (455)..(455): n is a, c, g, or t
  modified_base (457)..(478): a, c, t, g, unknown or other
  misc_feature (457)..(478): n is a, c, g, or t
tcagtcgatcacgtcacgaccggtgctcgatttagagagcgtcacagggagttcttggcattgtctctggagtgggtggcccacatcgacccaggtgaaattgagagatcctatgcggactctgtgaagggccgattcaccatctccagagacaacgccaagagctccctgtatctgcaaaatgaacagtctgagacctgaggacacggccttctatttctgtgacaaaagggccccgtatggcagtagctaaagaggttctttgactccgtggggcccaagggaaccccgggtcaacccggtctcctcacgccctccaacccaaggggccccatccggtccttccccctggccnccctgctccaggacncactcganagcacngcggccctgggcngccngtcaaagctactcacgtgatcgactgaggcgggctgggcaaagggcgctaaagngnnnnnnnnnnnnnnnnnnnnnn

SEQ ID NO: 341228 - DNA, 619 bp, Homo sapiens
  misc_feature: GZ8MTXP01EXHO9.38.3.A03.1.454.CMB.2.raw
  modified_base (285)..(286): a, c, t, g, unknown or other
  misc_feature (285)..(286): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgccactggaacccagcagtgacattggtacttataaccatgtctctggtaccaacatcacccagaccaaggcccccaaatcataattannacgtcagtagtcggccctcgtaggggtttctgatcgtcttcncaggcccctcaagtctaggaccaaaccacggccctcccngacccatcctcgtagggcctccgaggttggaggacgagctagtactattacttgaccgtcctacaactaggtaggtaacgtacgtagggtacggggttttacggacgggttaacgggaacccgtaaagtcggacccggttccgtaacgggtctaacggacccgaaaggcccgtacggtccccccttcgggttcccttaccgtccccttcggttcccccaccccgttccccttacgtaacccgttcgtaaccg

SEQ ID NO: 341229 - DNA, 579 bp, Homo sapiens
  misc_feature: GZ8MTXP01ATGKR.38.3.A03.1.454.CMB.2.raw
  modified_base (555)..(579): a, c, t, g, unknown or other
  misc_feature (555)..(579): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaaagaacctcccttgtttctgcacatgagcggcctgcgagtcgaggacacggctgtctattattgtacgagagagtcggggtattacaaagctagtttgtattaggttcggggaccgaaagggacctagtggtcctaccgtctcttcacgccctacccaccgaacgggcccctacgtcccggttacccctttccccccgtcggcccctacccccttcctacccgaacggaccgtacctacccccgttcggtcgggggaccaccgacggcccgggcccgtggggcctcggtcccgttacgggtaccgtaaacgggtaccttacccttacccacggttcgtaccgtcgaacgttcggacggccggggtcgtcgggaccgaacgggcacgtaagtgggnnnnnnnnnnnnnnnnnnnnnnnnn

SEQ ID NO: 341230 - DNA, 432 bp, Homo sapiens
  misc_feature: GZ8MTXP01EHIX2.38.3.A03.1.454.CMB.2.raw
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (425)..(432): a, c, t, g, unknown or other
  misc_feature (425)..(432): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcatttgatatttggggccaaagggaccatggtcaccgtctcttcagcctccacaagggcccatcgtcttcccctggcacccncctccaagacncacccnctggggcacagcggccctgggctgcctggtcaaggactacttccacgtnactcgatgagtcgggctggcgagcgacataggnnnnnnnn

SEQ ID NO: 341231 - DNA, 709 bp, Homo sapiens
  misc_feature: GZ8MTXP01AUFZY.38.3.A03.1.454.CMB.2.raw
  modified_base (287)..(287): a, c, t, g, unknown or other
  misc_feature (287)..(287): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactattggtacttataaccatcgtctcctgtaccaacatcacccagaccaacgccccaaactcaataatttangacgtcagtacgtcgccctcgtagggggtttctgtactcgtacttctcacggtcccctacctaagtccgtacgggtacccaaaaacccgtacccgggtcccctaccccgttacggaacccctacgttccgttccggtcgggggtcccttacccggtaaggggtttacggaacggggtaccggacgggtaccgttacggtaactttacgtttaacgtttcggccgtacccttacgaaccgtaaggttagggtaacgttaccggtaagggggttacggggtttacggggacgggtaacgggaaacccgtaaaggtccgacccgttcgtaggaaccacggacccgaacggttccgtcccggcccccgttcggttccttaccttccgtacccgttcccctaccctccttcgtaacgttcgtaaccg

SEQ ID NO: 341232 - DNA, 501 bp, Homo sapiens
  misc_feature: GZ8MTXP01ANRCG.38.3.A03.1.454.CMB.2.raw
  modified_base (489)..(501): a, c, t, g, unknown or other
  misc_feature (489)..(501): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaaagaactccctgtttctgcacatgagcggcctgcgagtcgaggacacggctgtctattattgtacgagagagtcggggattacaaagctatttgattagttggggaccaagggaccagtggtcaccgtctcttcacgccctaccaccgaacgggccccagttccggtcccttcccccgtggccctacccctcctacaagcgccacccccgtcggcgggggcacgacggcccgggcccgtgggcctcgccgtaggtacgaacgggtcttaccgttcccgacgtgacgtcgacgtggacggcgggctcgggacgaacggcgtacagtaggnnnnnnnnnnnnn

SEQ ID NO: 341233 - DNA, 530 bp, Homo sapiens
  misc_feature: GZ8MTXP02H4NUD.38.3.A03.1.454.CMB.2.raw
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
  modified_base (412)..(412): a, c, t, g, unknown or other
  misc_feature (412)..(412): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacggcccccaaactcaataatttangacgtcagtacgtcggccctcgaggggtttctgatcgcttctcaggcctccaagtctggacaacacggcctccctgacccatcctcngggctccgaggttgaggacgaggctgactatatgcgctnacatggatcgaggtagggtttcgcggaggaccaaaggtcgaccgtcgtaggtcacgtcccgaacggcctcgccccctcggtccacttccgtcgtcccgccctcctaccacgttcgacg

SEQ ID NO: 341234 - DNA, 550 bp, Homo sapiens
  misc_feature: GZ8MTXP02JFOT4.38.3.A03.1.454.CMB.2.raw
  modified_base (312)..(312): a, c, t, g, unknown or other
  misc_feature (312)..(312): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctctggtaccaacatcaccagacaacgcccccaaatcataatttatgacgtcagtagtccgcctcgaggggtttcngatcgtcttctcagcctcaagtctggcaacacgcctcctgacctatcctctgggctccgaggttgaggacgaggctgactattatgacgtcctcacatcggaatcgtagggtagggttttaccggacgggacgggaaccgaaaggtcggacccgtacgtagggtaccacgaccccgaaggccgtaccgcccccgtcgtccacttccgtcgttaccccaccctcctacaccgtagaccg

SEQ ID NO: 341235 - DNA, 527 bp, Homo sapiens
  misc_feature: GZ8MTXP02FV0LL.38.3.A03.1.454.CMB.2.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (411)..(411): a, c, t, g, unknown or other
  misc_feature (411)..(411): n is a, c, g, or t
  modified_base (479)..(479): a, c, t, g, unknown or other
  misc_feature (479)..(479): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttanaaccatgtctcctggtaccaacatcaacccagacaaggcccccaaactcataatttatgactcagtagtcggcctnaggggtttcngatcgcttctcaggcctccaagtctggcaacacggcctccctgaccatctctgggctccgaggttgaggacgagggcctagacttattattgcgctnacagtggaatcgagggtggtttcggaggaggaacctaaaggcgaccgtcgtaggtcacgccaaggccncgcccctcggtccacgtctccgttcccaccctcctacgacgttcgacg

SEQ ID NO: 341236 - DNA, 570 bp, Homo sapiens
  misc_feature: GZ8MTXP02JENP5.38.3.A03.1.454.CMB.2.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaactcataatttatgacgtcagtagtcgccctgaggggtttctgatcgcttctcagcctcagtctggcaacacggcctcctgaccatctcgtcgggctccgagttgaggacgaggctagactattattcgccgtctacactagtaggtactacgagggttacgggtttcgggacgggacgggtaacgtaaaggtcgaccgtaccgtagggtaccacggacccgaaacggtcctacccggcccccgtacggtcctaccgtcgtcccgttaccccacccgttcctcctacggtcgtaccg

SEQ ID NO: 341237 - DNA, 532 bp, Homo sapiens
  misc_feature: GZ8MTXP02H2D0T.38.3.A03.1.454.CMB.2.raw
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagtcgatcacgtcacgaccggtgctcgatttagagagcgtcacagggggcagcgctctcaggacatctccaccatggcctgggctctgctgctcctcacccctcctcactcagggcacagggtcctgggcccaatctgccctgactcagcctgcctccgtgtctgggtctcctggacagtcggtcgccatctcctgcactggaaccagcagtgacattggtacttataaccatgtctctggtaccaacatcaccagacaacggcccccaaactcataatttangacgtcagtagtcggcctgaggggtttctgatcgcttcncagcctccaagtctggacaacacggcctcctgacccatcctcgtgggcctccgaggttgaggacgaggctagactattatcgcgcctacactagtagaatcgagggtaggtttcggcggacggacgaaaggtcgaccgtcgtaggtcacgaccgaacgctcgccccgtcggtccacgtccgtcgttcccgccctcctcacgtacgtcg

SEQ ID NO: 341238 - DNA, 661 bp, Homo sapiens
  misc_feature: GZ8MTXP02IR2UI.38.3.A03.1.454.CMB.2.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcngtaccaanatcaccagacaagccccaaancaataatttangacgtcagtagtcgcctnaggggtttctgatcgcttctcacggcctaccaaagtctaggcaaacaccggccctccctgaacccatcctcgtcgggtctacccgaggttcgaaggacgaaggtctagaacttatttaagttcgcgtacctacaactaagttagggtaaaattcgaagggggttaagggggttttaccggggacggggtaaaggggaaacccgtaaaagggttacgggaacccggtttacgtaacggggttacccgaacgggacccccgaaaacgggtcccttaccggccccccccgttgggtacccctaacggtcccttaacggttcccccctaaccccgtccccgtttaccaaacggtttccggtaaaccg

SEQ ID NO: 341239 - DNA, 763 bp, Homo sapiens
  misc_feature: GZ8MTXP02HPOT2.38.3.A03.1.454.CMB.2.raw
  modified_base (297)..(297): a, c, t, g, unknown or other
  misc_feature (297)..(297): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcacgtggaaccagcagtgactagttggtaacttataacctatcgtcctcgtacgtaccaacactaccaccagaccaacgaccccaaatcaattaatttangacgtcagtacgtccgcctgtagggtttctgtactcgtacttcgtcgacggtccctacgtacgtcgtacggacaacccgccggtcccttacccgtacgacccttacgttccgttccggtcgggtcccgtaccggtaggggtttacggaacggggtaacggtacggtacgttacgttaaccttaacgtttacggttcgacccgtacccttaccgtaaccgttaagggtaacggttaaacggttcgggttaaacggggggtttacgggggttttaccgggggaaccggggtaaacggggtaaccgtaaaacggggttcccggtaacccggttaccggtaacgggtaccgaaacccggacccgggtaaaccggtcccgttaacccggtcccccgtaccggttacccgtacccgttcccggttccccgttccccgtaccccgttccgtaccgtaccggttaccgtaccgg

SEQ ID NO: 341240 - DNA, 436 bp, Homo sapiens
  misc_feature: GZ8MTXP02G5T8V.38.3.A03.1.454.CMB.2.raw
  modified_base (318)..(318): a, c, t, g, unknown or other
  misc_feature (318)..(318): n is a, c, g, or t
  modified_base (425)..(436): a, c, t, g, unknown or other
  misc_feature (425)..(436): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattattgtacgagagatcggggattcaaagcatttgatatttggggccaagggaccatggtcaccgtctcttcagcctccaccaaggcccatcggtcttccccnggccaccctcctccaagacgcacccctcgtggggcacagccgcctgggctgcctgtcaaggctacttccacgtgactcgactgagcgggctggcaagcgacagtagnnnnnnnnnnnn

SEQ ID NO: 341241 - DNA, 650 bp, Homo sapiens
  misc_feature: GZ8MTXP02IK9GL.38.3.A03.1.454.CMB.2.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctctgcactggaaccngcagtgactattgtacttataaccatntctctggtaccaacatcaccagacaacgccccaaactcataatttangacgtcagtacgtccggcctcgtacggggtttctgtatcgtcttctacgacggccctaccgtaagtctacggaccaaccgacccgggtcccttcccgtagaacccctattcccgttcgtacggggtccctaccgtagggttacggacgggaacggaggtacgtagtaccttaattcgttacgccgtcctacacgtaagtaggtaacgtcggtagggttacggggtttcgggacggtacggggtaacaaaggtcgtaaccgtcgtacggtacgacggaccgacggtccacccggtcccccgtacggttccctaccgttccgttcccggttcccccgtacccgttccgtaccggtaccgtacgtaacccgg

SEQ ID NO: 341242 - DNA, 716 bp, Homo sapiens
  misc_feature: GZ8MTXP02IRSPG.38.3.A03.1.454.CMB.2.raw
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
tcagtcgatcacgtcacgaccggtgctcgatttagagagcgtcacagggggcagcgctctcaggacatctccaccatggcctgggctctgctgctcctcaccctctcactcagggcacagggtcctgggcccaatctgccctgactcagcctgcctccgtgtctggtctcctggacagtcggtcgccatctcctgcactggaaccagcagtgactattggtacttataaccatgtctctgtaccaacatcaccagacaaccgcccaaactnataatttangactcgagtacgcggcctcgacgggtttcngttatccgcttctcgaggcccctacgaagtctcggaccaaccgcggccctccctacgaccctgtcctcgtcgggtcctaccgtagggtttacggacggaacggtacggtacgtacgtacttttaacgttacgttccgtaccgtacccttaccgaaccttaaggtcgggttaaaccgaaggttttaccgggggttaacggggtacgggggtttacccgggaaaaccgggtttaacgggaaccggtaaaccggttaccgggtaaccggtaacggtacccggtaaccggaaccggtaccggtaccccggtccccggttaccggtacccccgttcccgttaccgttcccgtaacccccgttcccccgttaccccgtaccccgttaccccgtaacgtacccggttacccgg

SEQ ID NO: 341243 - DNA, 603 bp, Homo sapiens
  misc_feature: GZ8MTXP02IYMS3.38.3.A03.1.454.CMB.2.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcaccagacaacgcccccaaactcataatttatgacgtcagtagtccggccctcgtagggtttctgatcgtcttctcgaggccctaccgagtctacggacaaccgaccggcctccctgaccctactcctcgtcgggcctacccaaccgtgacggacggacggtctacgtaaccttattacgttcgactacgtctacaattaactacaacgtcaacggtccgtcgttacggttggggtcggttcggggacgggacggggacccgtaccgtggtacccggttcgttacggtacacggtacccaagggtcctccggcccccgttacggtccaccgtcctcgttacccctaccccg

SEQ ID NO: 341244 - DNA, 570 bp, Homo sapiens
  misc_feature: GZ8MTXP02GKX47.38.3.A03.1.454.CMB.2.raw
  modified_base (179)..(179): a, c, t, g, unknown or other
  misc_feature (179)..(179): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacngtcggtcgccatctcctgcactggaaccagcagtgactattggtaacttataaccatgtctcctgtaccaacatcaccagacaacgccccaancatattatgactnagtagtccgcctgtagggttctgatcgcttctcagcctacagtctggacaaccgcggccctccctgaccatctcgtcgggcctccgtaggtgacggacgaggctagacttattagtcgcgcctacacagtagaagtcgaggggtaggtttcggacgggtaggaacgtaagtcgaccgtacgtacggtacgacgtacccgaacggtccgtaccgtcccccgttacgtccgtacctcccgtttacccgttaccccgtacccttacccgtccgtacggtacgtaaccg

SEQ ID NO: 341245 - DNA, 813 bp, Homo sapiens
  misc_feature: GZ8MTXP02GC4FN.38.3.A03.1.454.CMB.2.raw
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactattggtacttataaccattgtctcctacggtaccaacatcaacccagaaccaacggacccccaaactactaattaaactttatacgacgttcaaggttacgtccggtccccgttacgtacgggggtttcctaggtacttccggtcctttccgtacgtacggtaccccttacccgtaaagtccgtacgggacctaaaccgaaccccgggtccccttcccccgtaacggtaaccccttaacgttcccgttccggttacgggggtcccttacccgggttaaggggttttaaccggaaggggtaaccgggaaacggttccgttaacgtaacgttttaactttaacggtttcgaccccggtcccttaccgaaagttacggtacgggtaaacttaccgggtaagggggtttaccgggggttttaccggggacgggggttaagggacccggtaaaagtcgggtaaaccgtccgggttaacggtacgaccggtaccccgaaacggtccccgtaccggtaccccccgttcggggtaccctaaccgttcccgttacccggttcccccggtaccccttccgtaacccgtacggttccggtaaaccgg

SEQ ID NO: 341246 - DNA, 668 bp, Homo sapiens
  misc_feature: GZ8MTXP02JPO7Q.38.3.A03.1.454.CMB.2.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttanaaccatgtctctgtaccantcaccanacaacgccccaatcatattangactcagtagtccggcctcgaggggtttctgatcgcttctcgagccctaccaagtctcggaccaacgaccgtccctcccgtgaacccgtatccgtacgtcgggtcctaccgtaggtttggaagggaccggaaggtccgtagtaccgttaatttacgttcgaccgtccttacgaaccgtaagtacgggtaagtaccggtaagggggttacggggttttaccggggacggggtaacgggtaaccggtaaacgttcggtacccgtacgtaacgggttaccgaacggtacccgtaaacgggccgtaccggtacccccgtaccgggtccctaaccgttcccgttcccggtaacccccgtccccgttcccgttacccggtaccggtttacgtaacccgg

SEQ ID NO: 341247 - DNA, 510 bp, Homo sapiens
  misc_feature: GZ8MTXP02GQUD4.38.3.A03.1.454.CMB.2.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgactattggtacttataaccatgtctctggtaccaanatcaccagacaacggcccccaaatcataatttangacgtnagtagtcgcctnagggtttctgatcgcttncagcctcaagtctcggcaacacggcctccctgaccattctctcgggctccgacggttgaggacgaggctagactattatgcgcctcacatggaatcgaggtaggtttcggcggtaggaccaaagcgacgtcgagtcagccacgctcgtccccgtacgcactcgtcgttacccacctcctcgacgtcgacg

SEQ ID NO: 341248 - DNA, 636 bp, Homo sapiens
  misc_feature: GZ8MTXP02IMLMC.38.3.A03.1.454.CMB.2.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (280)..(281): a, c, t, g, unknown or other
  misc_feature (280)..(281): n is a, c, g, or t
tcagtcgatcacgtcacgaccggtgctcgatttagagagcgtcacagggggcagcgctctcaggacatctccaccatggcctgggctctgctgctcctcacccctcctcactcagggcacagggtcctgggcccaatctgccctgactcagcctgcctccgtgtctgggtctcctggacagtcggtcgccatctctgcactggaaccngcagtgactagttgtacttataaccatgtctctgtaccanatcaccagacaacgccccaaactcataattannacgtcagtagtcgcctcgtagggtttactatctcttctctggctcccgagtctcggacaacgaccggtccctcccgtcgacctactcctacgtcggacctccgacggtctaggacgggaacgagggtccttaggtactttaacctaactcggtacctaaggtttccaaatttaactaaacaaagtccctaaacttaaccttcccgtttactttcgtttacgtttacggttaccgggtacggggaacggggtaccgtacggggttacgacccgttaccgttaaacgacgtaccggacccgtaaggtccgtaaccgcccccgtacggtcctacgttccgttaccgtcccctaccccg

SEQ ID NO: 341249 - DNA, 605 bp, Homo sapiens
  misc_feature: GZ8MTXP02I8CPO.38.3.A03.1.454.CMB.2.raw
  modified_base (584)..(605): a, c, t, g, unknown or other
  misc_feature (584)..(605): n is a, c, g, or t
tcagtcgatcacgtcacgaccggtgctcgatttagagagcgtcacagggagttcttggcattgtctctggagtgggtggcccacatcgacccaggtgaaattgagagatcctatgtggactctgtggagggccggttcaccatctccagagacaatgaccaagaacctccctgtttctgcacatgagcggcctgcgagtcgaggacacggctgtctatttattgtacgagagagtcggggattacgaaagtctatttagtattaggtttcggggaccgtaaaggggacctagttacggtcctaccccgttcttccttacgaccgcccctaccccgaaccgaacgggacccctagttccccggttcccctttaccccccgtcggtccccctaccccgttccccctaccgaacgtaccgccctaacccccgttccggggcgggggaccaaccgccggcccgggtcccggtcgggggcctcggtaccgtacggtacgaaacggtaccctttaccctacccgtacggtcgtacgtcggtacgtagggcggccggggtcgtcgggacggaacgggcgaccgaagtggcnnnnnnnnnnnnnnnnnnnnnn

SEQ ID NO: 341250 - DNA, 585 bp, Homo sapiens
  misc_feature: GZ8MTXP02JCUTG.38.3.A03.1.454.CMB.2.raw
  modified_base (217)..(217): a, c, t, g, unknown or other
  misc_feature (217)..(217): n is a, c, g, or t
  modified_base (298)..(298): a, c, t, g, unknown or other
  misc_feature (298)..(298): n is a, c, g, or t
  modified_base (413)..(413): a, c, t, g, unknown or other
  misc_feature (413)..(413): n is a, c, g, or t
  modified_base (564)..(564): a, c, t, g, unknown or other
  misc_feature (564)..(564): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccagtctgccctgactcagcctgcctccgtgtctggtctcctggacagtcgactcacctatctcctgcacgtggaacgctagtagngtaactagttggtagttaataactatcgtctcgtagtaaccaacaaccaccagacaaaccgaccccaaatcatctatttangactcactcacgtccgccgtacgtcggtttctacgtcgtctctcgtcgtcctacgtagttcgactaacgccgcctccgtcgtactacgttcgcggctcgagtcgtagacggacgnggtctagttatttacgtcgtctacgtatatacgtagacggtcacggcaacgtccctaaccgttgtcgttacgtacggaacgtcgggaacctacggtcctaccgtcctacgtcgaccgtacccgaaccgtaccccaaaccgtctacgtaccncttccgtacccgtccctaccc

SEQ ID NO: 341251 - DNA, 437 bp, Homo sapiens
  misc_feature: GZ8MTXP02FHP2G.38.3.A03.1.454.CMB.2.raw
  modified_base (430)..(437): a, c, t, g, unknown or other
  misc_feature (430)..(437): n is a, c, g, or t
tcagtcgatcacgtcacgaccggtgctcgatttagagagcgtcacaggggagttcttggcattgtctctggagtgggtggcccacatcgacccaggtgaaattgagagatcctatgtggactctgtggagggccggttcaccatctccagagacaatgccaagaactccctgtttctgcacatgagcggcctgcgagtcgaggacacggctgtctattatgtacgagagatcgggattcaaagcattgatattgggcaaggcatggtcacgtctcttcagcctccaccaacgggcccagtcggtccttccccctggccaccctcctccaagacgcacccctcgtggggcacaggccgccgtgggctcgccgtcgggtcgtactacttccacgtgacttcgaactgaggcgggctggcgaagcgcaatagnnnnnnnn

SEQ ID NO: 341252 - DNA, 757 bp, Homo sapiens
  misc_feature: GZ8MTXP02JLCMI.38.3.A03.1.454.CMB.2.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
tcagtcgatcacgtcacgaccggtgctcgatttagagagcgtcacagggggcagcgctctcaggacatctccaccatggcctgggctctgctgctcctcaccctcctcactcagggcacagggtcctgggcccaatctgccctgactcagcctgcctccgtgtctgggtctcctggacngtcggtcgccatctcctgcactggaaccngcagtnactattggtacttanaccatcgtctctggtaccaacatcaccagacaacgaccccaaatcataatttancgactcagtacgtcggcctagtaggggtttcngtactcgtcttcgtcgacggtccctacgacgtctacggactaaccgaccgggtcccttcctaggaccctacgtcctacggtcgggtccctaccgtagggttacgacgggtacgaggtaccgttacgtaaccgttattttaacggtcgtacccgtaccgttaccgaactacggttacggtaacgttaccgggtaacgggggtttaacgggggttttccggggaacgggggtaaccggggtaaaacccgtaaaggggttcccgggtaaacccggtttccgtaaacggggttacccgaaacccggttaccccgggaaaacggtaccccggttccccgtacccccggttcccggggttaccctaacccgtttcccggttaccccgggtttaacccccctccccgttacccccgtttacccggtaaccggtttacccggtaacccgg

SEQ ID NO: 341253 - DNA, 518 bp, Homo sapiens
  misc_feature: GZ8MTXP01EXQ22.51.64.F09.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacacctagcctggtatcagcagaagcctggccaggctcccaggcctcctcatctatggttcatccaccagggccgctgatactccccagccaggttcagtcggcagtgggtctggggaacagaattcactctcaccntcagcagcctgcagtctagaagtattttgctagtttattactgttcagtcagtatgataagtggtccttccgtactacgttttcggccgaaggggtccagggcttgggagtattacgaaacgactggtcggctgcacctaagttctg

SEQ ID NO: 341254 - DNA, 580 bp, Homo sapiens
  misc_feature: GZ8MTXP01AFQD7.51.64.F09.1.454.CMB.2.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccacctctcctgcagggccagtcagagtgtttacaaacactagcctggtatcagcagagctggcaggctccagctctcatctatggttcatccaccagggccnctgatactcccagccaggttcagtcggcaggtgggtctgggaacagtaattcactctcaccntcagcagcctgcagtctagaagtattttgcttagtttattactgtcgagtctagttatagtaagtaagtcggtacccgttccgttacttacgttttcgggacccggtaacgggggaacccttaggggtccgttagggaacgtaacgttaccgaaaaacggttaccggtgggttacgggtccgttacgggaccgttaccccgttaagttccctttcgg

SEQ ID NO: 341255 - DNA, 537 bp, Homo sapiens
  misc_feature: GZ8MTXP01DH4PC.51.64.F09.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaangccaccctntcctgcagggccagtcagatgtttacaacaacctgcctggtatcagcagagctggcaggctccagctcncatctatgtcatccaccgagggccnctgactactcccgagcctaggttcagtcggcaggtgggtctgggaacagtaattcactctcaccatcagcagcctgcagtctagtaagttatttgacttagtttattacttgtactagtactagtatagtaagtaaggtcggtaccttaccgtacttacgtttcgggccgtaaggggaccaggtcgttaggagtattacgaaacgttacgtggtagcgtcgcacctaagttcgtcg

SEQ ID NO: 341256 - DNA, 584 bp, Homo sapiens
  misc_feature: GZ8MTXP01DIZCR.51.64.F09.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttacaacacctagcctggtatcagcagagcctgccaggctcccagctctcatctatgttcatccacaggccntgatancccagccaggttcagtcggcagtggtctgggaacagaattcactctcaccatcagcagcctgcagtctagaagtatttgctagtttattactgtacgtagtacgtagttagtagtaagttaaggtcggtacccgttaccgttaaccttaccgttttcgggacccgtaacgggggtaacccgacggggtaccgttaggggaacgtaacgttaaccgaaaacggttaaccgttgggtacggtaaccgttcggaccgttaaccgtaacttaacgtttccg

SEQ ID NO: 341257 - DNA, 512 bp, Homo sapiens
  misc_feature: GZ8MTXP01D7YMK.51.64.F09.1.454.CMB.2.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (477)..(477): a, c, t, g, unknown or other
  misc_feature (477)..(477): n is a, c, g, or t
  modified_base (508)..(508): a, c, t, g, unknown or other
  misc_feature (508)..(508): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttcaacacctagcctggtatcagcagagcctggccaggctcccaggctcctcatctatggttcatccaccgagggccnctgatactccccagccaggttcaggtcggcaggtgggtctgggaacagaattcactcncacatcagcagcctgcagtctagagtatttgctagtttattactgtcagtctagtatgtatagtgcctctatactacgttttggaactaggggaccagggttcgtagggtanagttcgaaacgaacgtgtggctgctaaccgnttcg

SEQ ID NO: 341258 - DNA, 505 bp, Homo sapiens
  misc_feature: GZ8MTXP01AOHLA.51.64.F09.1.454.CMB.2.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacactagcctggtatcagcagaagcctggccaggctcccaggctcctcatctatggttcatccacaggccntgatatcccagccaggttcagtcggcagtgggtctgggaacagaattcactctcaccatcagcagcctgcagtctagaagtatttgctagtttattactgtcagctagtatgataagtggacctccgtactacgttttcggccgaaggggccagggtcgttggagattacgaaacgactggtggctgcacctaagttcttg

SEQ ID NO: 341259 - DNA, 508 bp, Homo sapiens
  misc_feature: GZ8MTXP01EG9ET.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgttcaacacctagcctggtatcagcagagctggcaggctcccagctccnatctatgtcatccacagggccnctgatactcccagcctaggttcagtcggcaggtgggtctgggaacagaattcacttcncaccatcagcagcctgcagtctagtagtatttgacttagtttattacttgtcagtntagtatgtagtagtcggtaccttcgtactacgtttcggccgtaaggggccgagggcgttggagtattacgaaacgacgtgtgcgtgcactcttcgtcg

SEQ ID NO: 341260 - DNA, 558 bp, Homo sapiens
  misc_feature: GZ8MTXP01ENRBH.51.64.F09.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
tcagcgatcgtatacacgaccggtgctcgatttagcgcgtatacaagggggaggaactgctcagttaggacccagacggaaccatggaagccccagcgcagctttctcttcctcctgctactctggctcccagacaccactggacaaatagtgatgacgcagtctccaggcaccctgtctgtgtctccaggggaanagccaccctntcctgcagggccagtcagagttgtttacaaacaacctagcctggtatcagcagaagcctggccaggctcccaggctcctcatctatggttcatccacagggccntgatactcccagccaggttcagtcgcaggtgggtctagggaacagaacttcactctcaccatcagcagcctgcagtctagtaagttatttgacttagtttattacttgttcgtagtacgtagttatagtaagtaaggttcggtacccgttccgttacttacgttttcgggccgtaaggggacccgttaggcgttaggagtaacttacgaaacgttacgtaaggtcgcgtcgaccactaacttcgttcg

SEQ ID NO: 341261 - DNA, 517 bp, Homo sapiens
  misc_feature: GZ8MTXP01EGSSG.51.64.F09.1.454.CMB.2.raw
  modified_base (96)..(96): a, c, t, g, unknown or other
  misc_feature (96)..(96): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
tcagcgatcgtatacacgaccggtgctcgatttagcgcgtatacaagggggaggaactgctcagttaggacccagacggaaccatggaagccccancgcagcttctcttcctcctgctactctggctcccagacaccactggacaaatagtgatgacgcagtctccaggcaccctgtctgtgtctccaggggaaangccaccctntcctgcagggccagtcagagtgtttcaacacctagcctggtatcagcagaagcctggccaggctcccaggctcctnatctatggttcatccacagggccntgatatccagccaggttcagtcgcagtggtctgggaacagaattcactctcaccatcagcancctagcagtctagagtatttgctagtttattactgtcgagctagttatagataagtcggtcctccgtactacgtttcggccgtaaggggcaggcgttgggaagtattacgaaacggaacgttggtcggtcttcggcactaacttcgttcg

SEQ ID NO: 341262 - DNA, 572 bp, Homo sapiens
  misc_feature: GZ8MTXP01B5VY6.51.64.F09.1.454.CMB.2.raw
  modified_base (199)..(199): a, c, t, g, unknown or other
  misc_feature (199)..(199): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggccaccctgtctgtgtctccgaaggggaaancgcccaccctctcctgcagggccagtcaagtagttgtttacaaacaacctagcctggtatcagcagaacgccgtggccaggcctcccgaggcctcctcatctatggttcactccaccgagggccntgatcncccgagcctaggttcaggtcggctaggtcgggtctaggggaaacagtaacttcaactctacacctatcagcagcctgctagtctagaagttatttgacttagtttatactgttacgagtctagtagtagtaagtaaggtcggtacccttccgtaacttacgtttcggccggtaacggggtaccgagggtcgttaggaagtacttacgaaacgactggtacggctcgacacgtaattcgttcg

SEQ ID NO: 341263 - DNA, 533 bp, Homo sapiens
  misc_feature: GZ8MTXP01BY5R3.51.64.F09.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctntcctgcagggccagtcagagtgttcaacacctagcctggtatcagcagagcctggccaggctccagctctnatctatggttcatccaccagggccnctgatactcccagccaggttcaggtcggctaggtgggtctggggaacagtaattcactctcaccatcancagcctgcagtctagaagtatttgcttagtttattactgtcgagtctagtatgtaataagtcgtacctcgtactacgtttcggccgtaaggggaccgaggtcgttgggacgtacgttacgaaacgttacgtggtacggcgttcggcaccgtaacttcgttcg

SEQ ID NO: 341264 - DNA, 555 bp, Homo sapiens
  misc_feature: GZ8MTXP01BU0VF.51.64.F09.1.454.CMB.2.raw
  modified_base (194)..(194): a, c, t, g, unknown or other
  misc_feature (194)..(194): n is a, c, g, or t
  modified_base (419)..(419): a, c, t, g, unknown or other
  misc_feature (419)..(419): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccagggaanaagccaccctcctcctcgcaggccgacgtcagagtgtttctaacaacctacgctcgtagtcagcagaagcctcggcacggctccccacggctcctcatctatggttcactccacccaggcggcctgatatcccagccaggttcacgtggcagtgggtctgggaacagaatcactctcacatcagcagctgcagtctgaagtatttgcagtttattatgtcagacngtaatgtataaacgtggtccctccgttacgtaaccttttggccgaaggggtacccgttagggcgttggtaaggacttaacaaaacccgttaaacgttcggttgggccttacggacgacccctaaatttcgttccgg

SEQ ID NO: 341265 - DNA, 490 bp, Homo sapiens
  misc_feature: GZ8MTXP01ECRAA.51.64.F09.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccattggacaaatagtgatgacgcagtctccaggcaccctgtctgtgtctccaggggaaangccaccctctcctgcagggccagtcagagtgtttcaaacaacctagcctggtatcagcagaagcctggccaggctcccagctcctcatctatgtcatccacaggccntgatancccagccaggttcagtcggcagtggtctgggaacagaattcactctcaccatcancagcctgcagtctagaagtattttgctagtttattactgtcagnagtatgataagtgctcgtactactttgcgaagggaccaggtcttggagattacaaacgaactgtggctgcacctaattcttg

SEQ ID NO: 341266 - DNA, 558 bp, Homo sapiens
  misc_feature: GZ8MTXP01D6OE2.51.64.F09.1.454.CMB.2.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (368)..(368): a, c, t, g, unknown or other
  misc_feature (368)..(368): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaagggggaaancgcccaccctctcctgcagggccagtcagtagttgtttacaaacaacctagcctggtatcagcagagctgcagctccagctctnatctatgtcatccacgaggccntgatacncccagccaggttcagtcgcaggtggtctgggaacagtaacttcactcacacatcancagctgcagttctagtaagttatttgacttagtttattacgtgtacgagtctagtatagtaagtaaggtcgtaccctactaattacgttacgttttcgggtaacgtaacgggggttacctgggttacgtagggaagttaacgttaccgaaacggtaacgtggtcggtcgtcgactaaccgttaagttccg

SEQ ID NO: 341267 - DNA, 510 bp, Homo sapiens
  misc_feature: GZ8MTXP01EQMT1.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaangccaccctntcctgcagggccagtcagagtgtttcaacacctgcctggtatcagcagagctggccaggctcccaggctcnatctatggttcatccacgagggccnctgactactcccagccaggttcagtcggctaggtgggtctgggaacagtaattcactctcaccatcagcagcctgcagtctagtaagtatttgacttagtttattactgtctagtcagtatgagtaagtcgtacctccgtactacgtttcggccgtaagggtacagggcgttggagattacgaaacgactgtggctgcactcgttctcg

SEQ ID NO: 341268 - DNA, 553 bp, Homo sapiens
  misc_feature: GZ8MTXP01EDT21.51.64.F09.1.454.CMB.2.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttacaacacctagcctggtatcagcagaagcctggccaggctcccaggctcctnatctatggttcatccaccgagggccnctgactactcccagccaggttcagtcgcagtggtctgggaacagaattcactctcaccatcagcagcctgcagtctagtaagtatttgacttagtttattacttgtctagtactagtagtagtagtaagtcggtacccttcgttactacgttttcggccggtaacggggtacccgagggcgttagggagtaagttaacgaaacgttaacgtggtacggcgttggccttaccgtaacgttcgttcg

SEQ ID NO: 341269 - DNA, 584 bp, Homo sapiens
  misc_feature: GZ8MTXP01ERI56.51.64.F09.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctntcctgcagggccagtcagagttgtttacaacaacctagcctggtatcagcagagcctggccaggctcccaggcctccncatctatggtcatcccacgagggccntgatactcccgagcctaggttcaggtcggctaggtggtctgggaacagtaacttcactctcaccatcagcagctgcagtctagaattatttgcttagtttattactgttacagtctagtagtagtagtaacgttcggtacccgttccgttaacgttacgttttcgggaccggtaacggggtaccgttagggtccgttagggaacgtaacgttaacgaaaacggttaacgttcggttacggaacgttcggaccgttacctaacgtttccgtttcg

SEQ ID NO: 341270 - DNA, 495 bp, Homo sapiens
  misc_feature: GZ8MTXP01DK1IH.51.64.F09.1.454.CMB.2.raw
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (467)..(467): a, c, t, g, unknown or other
  misc_feature (467)..(467): n is a, c, g, or t
tcagcgatcgtatacacgaccggtgctcgatttagcgcgtatacaaggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttcaacaacctagcctggtatcagcagagctggccaggctcccaggctcctnatctatggttcatccaccagggccnctgatancccagccaggttcagtcggcaggtgggtctgggaacagaattcactctcaccatcagcagcctgcagtctagaagtattttgactagtttattactgtcagctagtatgataagtgcctccgtactactttggcctaagggccaggtcttggagnttacgaacgactgtgctgcactgttctg

SEQ ID NO: 341271 - DNA, 559 bp, Homo sapiens
  misc_feature: GZ8MTXP01AY78D.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagagtgtttctaaacacctagcctggtatcagcagaagctggccaggctcccaggctcctcatctatggttcatccaccagggccnctgatactcccagccaggttcaggtgcagtgggtctgggaacagtaattcactctacaccatcgacgcacgcctgcagtctagaagtatttacgntagtttattaacttgtacgtagtctaagtattagtaataagttcggtacccgttaccgttactacgttttcggccgtaaggggtaacccgagggtcgttggaagacgttacgaaacgttaaacgtggtaggcttcggacttacctaagttcgttccg

SEQ ID NO: 341272 - DNA, 543 bp, Homo sapiens
  misc_feature: GZ8MTXP01AIN9S.51.64.F09.1.454.CMB.2.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaaacacctagcctggtatcagcagaagcctggccaggctcccaggctcctcatctatggttcatccacgagggccnctgatactcccagccaggttcagtcggcaggtgggtctggggaacagaattcactctcaccatcagcagcctgcagtctagaagtatttgacttagtttattacttgtacagtctagtagtagtagtaagtcggtcctccgtactacgttttcggccgtaaggggaccgagggtcgttagggagtaacgttacgaaacgttacgtaaggtggtcgtggaccacctaacgttcttcg

SEQ ID NO: 341273 - DNA, 516 bp, Homo sapiens
  misc_feature: GZ8MTXP01BFZEK.51.64.F09.1.454.CMB.2.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttctaaacacctagcctggtatcagcagagctggccaggctcccaggctcctcatctatggttcatccaccagggccnctgatactccccagcccaggttcagtcggcaggtgggtctgggaacagaattcactctcaccatcagcagcctgcagtctagaagtattttgctagtttatactgtcgagtcagtatgtataagtggtcctccgtactacgtttggccgaacggggccaggcttgggagattacgaaacgacgtggtggctggacaccgtaattcgttcg

SEQ ID NO: 341274 - DNA, 549 bp, Homo sapiens
  misc_feature: GZ8MTXP01DZBOV.51.64.F09.1.454.CMB.2.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgttacaacactagcctggtatcagcagagcctggcaggctccaggctctnatctatgtcatccacgagggccntgatactccagccaggttcagtgcagtggtctgggaacagaatcactctcaccntcagcagctgcagtctagagtatttgcttagtttattacgttgtacgagtcgtagtagtgtaagttaaggtcggtacccttccgttacttacgttttcgggcccgtaagggggtacccaagggtccgttagggaacggtattaacgaaaacgttacgttaaggttcgggcttaggccttacctaacgttctttcg

SEQ ID NO: 341275 - DNA, 597 bp, Homo sapiens
  misc_feature: GZ8MTXP01DIEHJ.51.64.F09.1.454.CMB.2.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (398)..(398): a, c, t, g, unknown or other
  misc_feature (398)..(398): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanacgccaccctctcctgcagggccagtcagagtgtttcaaacaacctagcctggtatcagcagancctggccaggctcccagctccncatctatggtcatccaccgngggccntgactacncccagcctaggttcaggtcgctaggtggtctggggaacagtaacttcactctacaccatcagcagcctgcagtcagtatntttgcttagtttattacgtgtactagtcgtaagttatagtaagttaagtcggttacccgttacgttaccgttacgtttcgggaccggtaagggggtacccttagggtaccgttagggtaaacggtacgttaaaccggaaaaccggttacgttcgggtacgggtccgtacgggtaccttaaccgtaacgtttcgttaacg

SEQ ID NO: 341276 - DNA, 521 bp, Homo sapiens
  misc_feature: GZ8MTXP01DTKA3.51.64.F09.1.454.CMB.2.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (513)..(513): a, c, t, g, unknown or other
  misc_feature (513)..(513): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgttctaacacctagcctggtatcagcagaagctggccaggctcccaggctcctnatctatggttcatccaccgagggccntgatatccccgagccaggttcagtcggcagtgggtctgggaacagaattcactctcaccatcagcagctgcagtctagagtatttgcttagtttattactgtcgtaggactaaggttatgaattaaggtgtacccttccgtactacgttttggccgtaagggcagggcttggagtattacgaaacggttaactggtggctagcactnttcgttcg

SEQ ID NO: 341277 - DNA, 560 bp, Homo sapiens
  misc_feature: GZ8MTXP01AGPTV.51.64.F09.1.454.CMB.2.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacactagcctggtatcagcagaagcctggccaggctcccaggctcctcatctatggtcatccacngggccnctgatactccagccagttcagtcgcagtggtcngggaacagaattcactctcacatcagcagctgcagtctagtaagtatttgacttagtttacttacgttagtctagtcgtagtagtagtagttaagtcggtcccttccgtacttacgttttcggccggtaacggggacccgttagggtccgttagggaacgtaacgttacgaaacggttacgttgggtacgggtcttacggaccttacctaacgttccgtttccg

SEQ ID NO: 341278 - DNA, 495 bp, Homo sapiens
  misc_feature: GZ8MTXP01EJ894.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgtttcaacacctgcctggtatcagcagagctggccaggctcccagctcnatctatggtcatccacaggccnctgactanccagccagttcagtcgcagtggctgggaacagaattcactcncaccatcagcagcctgcagtctagatatttgctagtttattactgtcgagtctagtagtagagtaagtggccttcgtactacgtttggccgtaaggggaccaggcgttggagattacgaacgttacgtggtgctgcacctaagttcttg

SEQ ID NO: 341279 - DNA, 553 bp, Homo sapiens
  misc_feature: GZ8MTXP01CMVS4.51.64.F09.1.454.CMB.2.raw
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaancgcccaccctctcctgcagggccagtcagtagtgtttacaaacacctagcctggtatcagcagaagcctggccaggctcccaggctcctcatctatggttcatccacgagggccnctgatactcccgagccctaggttcaggtcggcaggtgggtctggggaacagaacttcactctcaccatcagcagcctgcagtctagtaagtatttgacttagtttatactagtcgagtctagtatgtagtagtcggtccttccgtactacgtttcggccgaacggggacccttagggcttagggaagtacgttacgaaacggttactaagggtcgtctcggcttacgtaacgttcgttcg

SEQ ID NO: 341280 - DNA, 517 bp, Homo sapiens
  misc_feature: GZ8MTXP01BBP4I.51.64.F09.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
  modified_base (469)..(469): a, c, t, g, unknown or other
  misc_feature (469)..(469): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacacctagcctggtatcagcagagctggcaggctccaggctcctcatctatggttcatccacaggggccntgactactcccagccaggttcaggtcggcaggtggtctggggaacaggtaattcactctcaccntcagcagcctgcagtctagaagttatttgcttagtttattactgtacagctagtatagtataggtcgtccttaccgtactacgtttcggccgtaaggggacngggcgttggagattacgaaacgttactgtggctgacacctgttcttcg

SEQ ID NO: 341281 - DNA, 497 bp, Homo sapiens
  misc_feature: GZ8MTXP01D20PM.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (497)..(497): a, c, t, g, unknown or other
  misc_feature (497)..(497): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagagtgtttacaacaacctagcctggtatcagcagaagcctggccaggctcccaggctccncatctatggttcatccacagggccntgatancccagccaggttcagtcgcaggtggctgggaacagaattcactctacaccatcagcagcctgcagtctagaagtatttgctagtttattactgtcagctagtatgataagtggtcctcgtactactttggcgaagggaccaggtcttggagattacgaaacgactgtgctgcacctaattcgtn

SEQ ID NO: 341282 - DNA, 515 bp, Homo sapiens
  misc_feature: GZ8MTXP01CECJU.51.64.F09.1.454.CMB.2.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttacaaacaacctagcctggtatcagcagagcctggccaggctcccaggctctcatctatgtcatccacagggccntgatactccagccaggttcaggtcggcaggtgggtctgggaacagtaattcactctcacatcagcagcctgcagtctagtaagtatttgacttagtttattacttgtctagtctagtatagtagtagtgtcctcgtactcgtttcggcgtaagggcgaggtcgttaggacgtagttacgaaacgacgtgtagctcgcactaacgttcttcg

SEQ ID NO: 341283 - DNA, 514 bp, Homo sapiens
  misc_feature: GZ8MTXP01DZOXT.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgtttacaaacacctagcctggtatcagcagagcctggccaggctccagctctnatctatggtcatccacgagggccnctgactancccagccaggttcagtcggcagtgggtctgggaacagtaattcactctcaccatcagcagcctgcagtctagaagtntttgacttagtttattactgtacagtctaagtatgaataaggtcggtacctcgtactacgtttggccgtaaggggaccaggcgttggagtattacgaaacgactggtaggctgacactaattcttcg

SEQ ID NO: 341284 - DNA, 534 bp, Homo sapiens
  misc_feature: GZ8MTXP01EHD8V.51.64.F09.1.454.CMB.2.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (381)..(381): a, c, t, g, unknown or other
  misc_feature (381)..(381): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccagggggaaangccaccctctcctgcagggccagtcagagttgtttactaaacaacctagcctggtatcagcagaagcctggccaggctcccaggctcctcatctatggttcatccacgagggccnctgacttactcccagccctagggttcaggtcggctaggtgggtctggggaacagtaattcactctcacntcagcagctgcagtctaggaattattttgacttagtttattactgtcagtctagtatagagtagtcggtacctcgtacttacgtttcggccgtaagggggccagggcttcggaagtacttacgaaacgactgggtaggctgcactgttcttcg

SEQ ID NO: 341285 - DNA, 549 bp, Homo sapiens
  misc_feature: GZ8MTXP01CK9NL.51.64.F09.1.454.CMB.2.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (490)..(490): a, c, t, g, unknown or other
  misc_feature (490)..(490): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggcctcccagacaccactggacaaatagtgatgacgcagtctccaggcaccctgtctgtgtctccgaaggggaaancgcccaccctctcctgcagggccagtcagagtgtttacaacaacctgcctggtatcagcagagcctggccaggctcccaggctcctcatctatggtcatcccacgaggccntgatacncccagccaggttcagtcggcaggtggtctagggaacagtaacttcactcaccacatcagcacgcctgcagtctagtaagtatttgacttagtttaatctagtacgtagtacgtagtatagtaagtaaggtcgtaccttcgtacgtacgtttcggaccggaacggggtaccgnggtcgttaggaagtacttaacgaaacgagttggacgtcgtacgacacgtaattcgttcg

SEQ ID NO: 341286 - DNA, 551 bp, Homo sapiens
  misc_feature: GZ8MTXP01C78GX.51.64.F09.1.454.CMB.2.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaagcgccaccctctcctgcagggccagtcagagttgtttacaaacacctagcctggtatcagcagagcctggccaggctccagctctnatctatgtcactccaccgngggccntgatacncccagcctaggttcaggtcggcaggtggtcngggaacagaattcactcncacatcagcagcctgcagtctagtaacgtattttgacttagtttattacttgtactagctagtatagtaagtaagtcggtaccttcgtacttacgtttcgggcgtaacggggaccgagggtcgttagggaacgtacttaacgaaacggttaacgtggtacggtcgtagaccacctaacgttcgtttcg

SEQ ID NO: 341287 - DNA, 522 bp, Homo sapiens
  misc_feature: GZ8MTXP01DBQWI.51.64.F09.1.454.CMB.2.raw
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (514)..(514): a, c, t, g, unknown or other
  misc_feature (514)..(514): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttacaacaacctagcctggtatcagcagagctgcagctccngctctnatctatgtcatccacgaggccntgatacncccagccaggttcagtcgcaggtggtcnggaacagaattcactcncacatcagcagctgcagtctagtagttatttgcttagtttattactgtcacgtctagtatagtattaaggtcggtcctaccgtacttacgtttcggaccggtaacggggaccgagggtcgttgggaagtacttaacgaaacgttacgtggtcgaactgaccactnttccgttg

SEQ ID NO: 341288 - DNA, 512 bp, Homo sapiens
  misc_feature: GZ8MTXP01BW82U.51.64.F09.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacacctagcctggtatcagcagagcctggccaggctcccaggctcctnatctatggttcatccacngggccntgatancccagccaggttcagtcggcaggtgggtctgggaacagtaattcactctcaccatcancagctgcagtctagaagtatttgcttagtttattactgtcagtctagtatagataagtcgtacctccgtactacgtttcggcgtaacgggccgaggcgttggagtattacgaaacgacgtgtggcgtgcactaacttcgttcg

SEQ ID NO: 341289 - DNA, 516 bp, Homo sapiens
  misc_feature: GZ8MTXP01EF38S.51.64.F09.1.454.CMB.2.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (353)..(353): a, c, t, g, unknown or other
  misc_feature (353)..(353): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctctcctgcagggccagtcagagtgttcaacaacctagcctggtatcagcagaagctggccaggctcccaggctcctnatctatggttcatccacagggccnctgatatcccagccaggtcagtgcagtggtctgggaacagaattcactcncaccatcagcagcctgcagtctagaagtatttgctagtttattactgtactagtctagttatagagtaagtcggtccgttcgtactacgttttcggcgtaacggggaccagggtcgttggagtacgttacgaacgaacgtgtgcgtgccacgtaacttcgtcg

SEQ ID NO: 341290 - DNA, 532 bp, Homo sapiens
  misc_feature: GZ8MTXP01BZJ6W.51.64.F09.1.454.CMB.2.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
  modified_base (479)..(479): a, c, t, g, unknown or other
  misc_feature (479)..(479): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgcccaccctctcctgcaggggccagtcagagttgtttactaaacaacctagcctggtatcagcaggaagcctggccaggcctcccaggctcctnatctatggttcatccacngggccnctgatactcccagccaggttcagtcgcagtgggtctggggaacaggaattcacgtctcacatcancagcctgcagtctagagtatttagcttagtttacttactgtcagtctagtatgaataggtggtcctcgtacttacgtttcgggcgtaacggggtaccnggcgttgggagtattacgaacggttagtggtagccgtgcactaacttcgttcg

SEQ ID NO: 341291 - DNA, 562 bp, Homo sapiens
  misc_feature: GZ8MTXP01DR49X.51.64.F09.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctntcctgcagggccagtcagagtgtttacaacacctagcctggtatcagcagaagcctggccaggctcccgaggctcctcatctatggttcactccacgagggccntgactactccagtccaggttcaggtcggctaggtggtctggaacagtaattcactctcaccatcagcagcctgcagtctagtaatatttgacttagtttattactgtcagtctagtatagtagttaagtcggtaccttcgttacttacgtttcggccgtaacggggaccgagggtcgttagggtaacgtacttaaccgaaacgttaaccgttgggtacggtccgttacggccgttaccctaattccgtttcg

SEQ ID NO: 341292 - DNA, 596 bp, Homo sapiens
  misc_feature: GZ8MTXP01CLKE5.51.64.F09.1.454.CMB.2.raw
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (372)..(372): a, c, t, g, unknown or other
  misc_feature (372)..(372): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaagggggaaangcccaccctctcctgcagggccagtcagtagtgtttacaaacaacctagcctggtatcagcagagcctggccaggctcccaggctcctcatctatggttcatcccacgagggtcnctgatacnccagccaggttcaggtcgcaggtggtctgggaacagaattcactctcacancagcagcctgcagtctagtaagttatttgactagtttattacttgtcgaggtactagttagtagtaagtaaggttcggtacccttaccggttaccgttacgttttcgggcccggtaacgggggtaaccgagggtccgttagggtaacggaacttaaccgttaaaacggttaaccggttggtacggggtaacttacggacccttaaccgtaacgttccgtttccg

SEQ ID NO: 341293 - DNA, 569 bp, Homo sapiens
  misc_feature: GZ8MTXP01EDTJO.51.64.F09.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgagggggaanacgccaccctctcctgcagggccagtcagagttgtttacaaacaacctagcctggtatcagcagagcctggcaggctcccagctccnatctatggtcatccacgnggccntgatcnccagccaggttcagtcggcaggtggtctgggaacagtaattcactctacaccntcagcacgctgctagtctagtaagttatttgacttagtttattacgtgtacgtagtacgtagttagtagtaagttaacggtcggtaccgttaccgttacgttaccgttttcgggaccggtaacggggaccgttacgggtcgttagggtacgtaacgttaacgaaacggttacgtggtacggtctcgacactaacgttcgttcg

SEQ ID NO: 341294 - DNA, 502 bp, Homo sapiens
  misc_feature: GZ8MTXP01DX016.51.64.F09.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctntcctgcagggccagtcagagtgttacaacacctagcctggtatcagcagaagcctggccaggctcccaggctctnatctatggtcatccacaggccntgatactcccagccaggtcagtcgcagtggtcnggaacagtaattcactcncaccatcagcagcctgcagtctagtagtatttgcttagtttattactgtacagtctagtatagataagtgtacctcgttactacgtttggcgaagggtccnggtcgttggaganacgacgagtgtagtcgtgcacctaagttcgttcg

SEQ ID NO: 341295 - DNA, 567 bp, Homo sapiens
  misc_feature: GZ8MTXP01BXH7V.51.64.F09.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagttgtttacaaacacctagcctggtatcagcagagctggccaggctccagctcctnatctatggttcatccacgaggccntgatacncccagcctaggttcagtcggcaggtggtctgggaacagtaattcactctacacatcagcacgcctgctagtcgtagtagttatttgacttagtttacttatgtactagtactagtagtagtaagttaacggtcggtacccttccggtacttaccgttttcgggacccgtaagggggaccgagggtcgttacgggaagtaacgttaacgaaacggttaaccgtgggtcggtcgtcgtaccgacctaacgttccttg

SEQ ID NO: 341296 - DNA, 519 bp, Homo sapiens
  misc_feature: GZ8MTXP01C6MEN.51.64.F09.1.454.CMB.2.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacacctagcctggtatcagcagaagcctggccaggctcccaggctcctcatctatggttcatccaccagggccntgatancccagccaggttcagtcggcaggtgggtctggggaacagaattcactctcaccatcagcagcctgcagtctagaagtattttgcttagtttattactgtcagtctagtatgtagtaagtcggtcctccgtactacgtttcggccgaaggggaccaggtcgttggagattacgaaacgacgtgtggctggcaccgtaagttcttcg

SEQ ID NO: 341297 - DNA, 570 bp, Homo sapiens
  misc_feature: GZ8MTXP01BO93B.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgtttcaacacctgcctggtatcagcagagctggcaggctcccaggctcctnatctatggttcatccacagggccntgatatcccagccaggttcagtcggcaggtggtctggggaacagaattcactctcaccatcagcagcctgcagtctagtaagtatttgcttagtttattacttgtcgtagtctaagttatgtagttaaggtcggtacccttaccggttacgttaccgttttcgggacccggtaacgggggtaaccaggggtcgttaggggacgtaacttaccggaaaacggttaaccgttgggtcgggtcgttcggaccttacccgtaagttccgtttcg

SEQ ID NO: 341298 - DNA, 581 bp, Homo sapiens
  misc_feature: GZ8MTXP01BY2A0.51.64.F09.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccacctctcctgcagggccagtcagtagttgtttacaaacaacctagcctggtatcagcagagcctggccaggcctcccagctccnatctatgtcactccacgngggccntgactacncccgagccgtaggttcaggtcggcgtaggtgggtctaggggaacaagtaacttcacttcacacatcagcacgctgcagtctagaagttacgttttgacgttaagtttattacgttgtacgagtctaagtagtagtagttaacgtcggtacctaccgttactacgtttcgggccgtaacggggtaccgttagggtcttagggaacgtaacgttacgaaacgttacgtggtacggtcgtacgtaccgttacctaacgttccgttcg

SEQ ID NO: 341299 - DNA, 535 bp, Homo sapiens
  misc_feature: GZ8MTXP01A7ZBC.51.64.F09.1.454.CMB.2.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanagccacctctcctgcagggccagtcagtagtgtttacaaacacctagcctggtatcagcagagcctggccaggctcccaggctcctcatctatggttcactccacagggccnctgactatcccagcccaggttcaggtcggctaggtgggtctggggaacagaacttcactctcaccatcagcagcctgctagtctagaagttatttgctagtttattacgtgtcagctagtatgagtaagtcgtaccttcgtacgtacgtttcggccgaacggggacagggcgttggaagtacgttacgaaacgttacgtgtaggctcggcactaacttcgttaacg

SEQ ID NO: 341300 - DNA, 581 bp, Homo sapiens
  misc_feature: GZ8MTXP01BX0A7.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagagtgttacaacacctagcctggtatcagcagaagcctggccaggctcccgaggcctctcatctatggtcatccacgagggccntgactactcccagccaggttcaggtcggctaggtggtctgggaacagtaacttcactctcaccatcagcagcctgctagtctagtaagtatttgacttagtttattactgtctagtacgtagttagtagtaagtaaggtcggtaccttaccgttaccgttacgttttacgggccgtaacgggggtacccgttagggtccggttaataacggtaacgttaaccgttaaacggttacggttggtacggtcgtacgtaccttaccgttcgttcgttcg

SEQ ID NO: 341301 - DNA, 600 bp, Homo sapiens
  misc_feature: GZ8MTXP01D1LWK.51.64.F09.1.454.CMB.2.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (323)..(323): a, c, t, g, unknown or other
  misc_feature (323)..(323): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaancgccaccctntcctgcagggccagtcagtagttgttactaaacaacctagccttggtactcagcaagacgcctggccaggcctcccgaggctcctcatcttagtggttcactccgacgagggccnctgactactcccgagtcctaggttcaggtcggctaggtggtctggggaaacagtaacttcaactcctcacatcagcagtcctgcagtacgtagtaagttatttcgtacgttagttttacttaacgttgtacgtagtacgtaagttagtagtaagttacggtacggttacccgttaccgttacgttacggtttacgggcggtaacggggtaccgaggtcgttaggtaacgtacttaacgaaacgttacgtaaggtcgcgtcgcactaattcgttaacg

SEQ ID NO: 341302 - DNA, 604 bp, Homo sapiens
  misc_feature: GZ8MTXP01CI8UV.51.64.F09.1.454.CMB.2.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (428)..(428): a, c, t, g, unknown or other
  misc_feature (428)..(428): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanacgccacctctcctgcagggccagtcagagttgtttacaaacaacctagcctggtatcagcagacgcctggccaggcctcccgaggcctcctcatctatcgttcactccacgagggccnctagatacncccagccaggttcaggtcgcaggtggtctagggaaacagtaacttcaactctaccacatcagcagtcagctagtctagtaatatttcgacttaatttaacttntacgtctacgtatagtatagtaagttaacggtcggttacccgtacgttaaccgttacgttttacggaccgtaacgggggaccgttacgggtcgttacgggaagtaacgttaaccgaaaacggttacggttaaggtacgggtaaccttcggaccttacccgtaacttccgtttaacg

SEQ ID NO: 341303 - DNA, 564 bp, Homo sapiens
  misc_feature: GZ8MTXP01BZ7LH.51.64.F09.1.454.CMB.2.raw
  modified_base (262)..(262): a, c, t, g, unknown or other
  misc_feature (262)..(262): n is a, c, g, or t
  modified_base (283)..(283): a, c, t, g, unknown or other
  misc_feature (283)..(283): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaagagcccaccctctcctgcagggccagtcagtagtgtttcaaacaacctgcctggtatcagcaganctggccaggctccagctcctnatctatgtcatccacgagggccnctgatactccagcctaggttcagtcggctaggtgggtctggggaacagtaacttcaacgtctcacatcagcagctgcagtctagtaagtatttgtacttagtttattacttgtcgtagtacgtagtatagtaagtaacggttacgtaccttaccgtacttacgttttcgggaccggtaacgggggaccgttagggtcgttaggaacgtaattaacgaaacggttaacgtaaggtgcgtacgacacctaacttcgttcg

SEQ ID NO: 341304 - DNA, 525 bp, Homo sapiens
  misc_feature: GZ8MTXP01DZ2OI.51.64.F09.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagttgtttacaaacacctagcctggtatcagcagagctgcagctcagctcnatntatgtcntccacnggccntgatctccagccgtaggttcaggtcgcaggtggtctgggaacagtaattcactctcactntcagcagctgcagtctagaattntttgcttagtttattacgttgttacatcgtaagttatagtaagtaagtcggtacctccgtacttacgtttcggcggtaacggggccaggtcgttaggagtaacaacgaaacgttacgtggtacggctcgacttactaattcgttcg

SEQ ID NO: 341305 - DNA, 567 bp, Homo sapiens
  misc_feature: GZ8MTXP01DDEV7.51.64.F09.1.454.CMB.2.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacacctagcctggtatcagcagaagctggccaggctcccaggctcctcatctatggttcactccaccgagggccntgatacncccagccctaggttcagtcggctaggtgggtctgggaacagaacttcacttctcaccatcagcagcctgctagtctagtaagtattttgacttagtttattactgtacgtagtcgtaagttatagtagtaacgtcggtaccttaccgttacttacgttttcgggccgtaacggggtacagggtcgttagggaacgtacttaacgaaacggttacgttggtacggtcgtcgaccttacgtaacttcgtttaacg

SEQ ID NO: 341306 - DNA, 538 bp, Homo sapiens
  misc_feature: GZ8MTXP01BJQDA.51.64.F09.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttacaacacctagcctggtatcagcagagcctggccaggctcccaggctcctcatctatggttcatccaccgagggcccntgactactcccgagccaggttcaggttcggctaggtgggtctggggaacagtaattcactctccacatcagcagcctgcagtctagaagtatttgctagtttattactgtcagtctagtatagtagtagtcggtccttccgtactacgtttcggccgaaggggaccagggtcgttaggaagtacttacgaaacgttaactgggtacggctcggaccacctaattcgttcg

SEQ ID NO: 341307 - DNA, 582 bp, Homo sapiens
  misc_feature: GZ8MTXP01CZBJA.51.64.F09.1.454.CMB.2.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaangcccaccctctcctgcagggccagtcagtagtgtttacaaacaacctagcctggtatcagcaagagcctggccaggctcccaggctctcatctatggttcatccacgagggccnctgatacncccagccaggttcaggtcggcaggtgggtctgggaacaagtaacttcaactctacactatcagcagcctgcagtctagtaagtatttgacttagtttattactgtacagtactaagttagtagtagtaagtcgggtaccttaccgtacttacgtttcggcccggtaacgggggtaaccagggtcgttagggaacgtaacgttaaccgaaaacggttacgttgggtacggtaacgttcggaccttaaccctaagttcgtttcg

SEQ ID NO: 341308 - DNA, 559 bp, Homo sapiens
  misc_feature: GZ8MTXP01ELWGF.51.64.F09.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
  modified_base (438)..(438): a, c, t, g, unknown or other
  misc_feature (438)..(438): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccagggggaaanagccaccctntcctgcagggccagtcagtagttgtttacaaacaacctagcctggtatcagcagagcctggccaggctcccaggcctctcatctatggtcatccacgagggccnctagactatccccagccgtaggttcaggtcggcaggtggggtctgggaacagaattcactctacacatcagcagcctgctagtctagtaatatttcgattagtttattactgtacagtctaagttanagtaatagtcggaccttaccggttacttaacgtttcgggcccgtaagggggaccagggtcgttagggaagtaacttacgaaacggacgtggtcggaactcgaccttaaccttcgttcgtcg

SEQ ID NO: 341309 - DNA, 547 bp, Homo sapiens
  misc_feature: GZ8MTXP01DW0WU.51.64.F09.1.454.CMB.2.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcacctgtctgtgtctccgaggggaaancgcccaccctntcctgcgagggccagtcagtagttgtttacaaacaacctgcctggtatcagcagagctgcaggctccagctcctnatctatgtcactccaccgaggccntgactactccagcctaggtcaggtcggcaggtggtctagggaacagtaattcactctcaccatcgagcagcctgcagtctagtagttatttcgacttagtttattacgttgtacagtgagttagtgtaagtaagttcggtaccttccgtaacttcgtttcggccggtaagggaccgaggtcgttaggaacgtaacttacgaaaccgttagtggtagcgtacacttactaacgttcgtttcg

SEQ ID NO: 341310 - DNA, 595 bp, Homo sapiens
  misc_feature: GZ8MTXP01A94HY.51.64.F09.1.454.CMB.2.raw
  modified_base (195)..(195): a, c, t, g, unknown or other
  misc_feature (195)..(195): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgtttacaaacacctagcctggtatcagcagaagcctggccaggcctccaggctctcatctatggttcactccacgagggcctctgactactcccgagccgtaggttcaggtcggcaggttgggtctgggaacagtaacttcaactctacacatcagcagcctgctagtctaggtaattattttgacgttagtttacttacgttgtacggtagtagtaagttagtagtaagttaacggtcgttacccgttccgttaacgttacgttttacgggccgtaagggggtacccgagggtccgttaggggaacgtaacgttaaccgaaacggttaccggtggttaggcctcggaccttaccgtaacttcgttccg

SEQ ID NO: 341311 - DNA, 618 bp, Homo sapiens
  misc_feature: GZ8MTXP01BRV6V.51.64.F09.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaancgccaccctctcctgcagggccagtcagagttgtttacaaacaacctagcctggtatcagcagagcctggccaggctcccagctcnatctatggtcatccacgngggccntgactactcccagcctaggttcaggtcggctaggtggggtctagggaacagtaacttccactctaccactatcacgcacgcctgcagtcgtagtaagttatttgacttagtttattacgtcgtacgagtacgtagttagtagtagttaacggttcggtacccgttaccggttaaccgttaccggttttacgggacccggtaacgggggtaaccgttggggtaccgttaggggtaaacgtaaccgttaacgttaaaaccggttacgttgggtcgggtaacgttcggacccttacgtcgtttcgtttaaccg

SEQ ID NO: 341312 - DNA, 658 bp, Homo sapiens
  misc_feature: GZ8MTXP01BC5DW.51.64.F09.1.454.CMB.2.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (308)..(308): a, c, t, g, unknown or other
  misc_feature (308)..(308): n is a, c, g, or t
  modified_base (427)..(427): a, c, t, g, unknown or other
  misc_feature (427)..(427): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaanagcccaccctctccngcagggccagtcagagttgtttacaaacacctagcctggtatcagcagagcctggccaggctcccagctcctcatctatgtcactccacgagggccnctgactactcccagcccgtaggttcaggtcgggctagggttggggtctaggggaaacctagggaactttccaacgtcctaccaccgatccagtccagccctggcagttctagtaagttnttttgacttagtttacttaacgttcgtacagtacgtaagttagtagtaacgttaacggttccggtacccgttaccggttaccgtttaccggttttacggggaacccggttaacggggggaacccttagggggtacccgttagggggtaactaaacgttaaccggttaaaaccgggttaacgttaagggtcgggtaaccgttacggaccgttacccttaagttccctttcgg

SEQ ID NO: 341313 - DNA, 576 bp, Homo sapiens
  misc_feature: GZ8MTXP01C8EP4.51.64.F09.1.454.CMB.2.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
  modified_base (505)..(505): a, c, t, g, unknown or other
  misc_feature (505)..(505): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttacaacacctagcctggtatcagcagaagcctggccaggcctcccaggcctcctcatctatggttcactcccaccgngggcccntgatcncccagccctaggttcaggtcgcaggtggtcnggaaacagtaatcactctacacatcagcacgcctgctagttcgagtaagttatttcgacttagtttattacgtgttacgagtacgtaagttataggtagttaaggtcggtacccttacgttaccttacgtttcggaccggtaacggggtaccgnggtacgttagggaactacgttaacgaaacgttacgtggtacggcgttcggaccttaccgtaacttcgttcg

SEQ ID NO: 341314 - DNA, 622 bp, Homo sapiens
  misc_feature: GZ8MTXP01A1BFI.51.64.F09.1.454.CMB.2.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgatcgtatacacgaccggtgctcgatttagcgcgtatacaagggggaggaactgctcagttaggacccagacggaaccatggaagccccagcgcagcttctctccctcctgctactctggctcccagacaccactggacaaatagtgatgacgcagtctccaggcaccctgtctgtgtctccgaggggaaancgccaccctctcctgcagggccagtcagagtgtttacaacacctagcctggtatcagcagaagcctggccaggcctcccaggcctcctnatctatggttccatccaccgagggccgctgactactcccagcctaggttcaggtcggcaggtgggtctagggaacagaattccactctacaccatcgagcagctgcaggtctagaagttatttgtacgttagtttaacttacttaggtacgtaagtacgtaaggttaagttaggtaacgttaacggttacggtacccgttaccgttaccgttacgttttacgggcccggtaaggggacccgttagggtcgttagggaaacgtaacgttaaccgttaaaacggttaaccgttgggtggtaaccttacggacccgttaaccgtaagttcggttaaccg

SEQ ID NO: 341315 - DNA, 629 bp, Homo sapiens
  misc_feature: GZ8MTXP01AN56V.51.64.F09.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagngttgtttacaaacaacctagcctggtatcagcagaacgcctggccaggcctcccgaggtctcctcatctatggttcactccaccgagggccntgactctcccagccaggttcaggtcggcgtaggtggggtctaggggaacaggtaacttcactctcgacctatcacgcagcctgactagtcgtagtaagttatttcgacttagtttacttacgttgttacgagtacgtagttagtagtaacgttaaggtccggtaccccgtttaccggttaaccgttaccggttttacggggcccggtaacgggggtaacccgttaggggtaccgttagggtaacgtaacgttaaccgaaaacggttacgtgggtacggtcgtacggtaccttaccgtaacttcgttaaccg

SEQ ID NO: 341316 - DNA, 536 bp, Homo sapiens
  misc_feature: GZ8MTXP01DK32G.51.64.F09.1.454.CMB.2.raw
  modified_base (196)..(196): a, c, t, g, unknown or other
  misc_feature (196)..(196): n is a, c, g, or t
  modified_base (310)..(310): a, c, t, g, unknown or other
  misc_feature (310)..(310): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttacaacaacctagcctggtatcagcagaagcctggccaggctcccaggctcctcatctatggttcatccaccgagggccntgatctccagccaggttcagtcgcaggtggtctggaacagtaatcactctacacntcancagctgcagtctagtaagtatttgacttagtttattactgtacagtcgtagtatgagtaaggtcgaccttccgttactcgtttcggccgtaacgggggaccaggtcgttggaacgtattaccgaaacgttacgtggtacggtctcggacttacccgtaattcgttcg

SEQ ID NO: 341317 - DNA, 591 bp, Homo sapiens
  misc_feature: GZ8MTXP01BFK3K.51.64.F09.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctntcctgcagggccagtcagtagttgtttacaaacaacctagcctggtatcagcagagcctggccaggctccagctcncatctatgtcatccacgagggccntgatactcccagccaggttcaggtcggcaggtgggtctggggaacagtaatcactctcacatcagcacgtcctgctagtcgtagtaagttatttgtacttagtttattacgtgtacgagtacgtagtagtagtaagtacgttcggtacccgttaccgttaccgttacgtttacgggccggtaacgggggtacccgagggtccgttagggaacgtaacgttaaccgttaaaccggttacgttcgggtacggtccgttcggaccttaccgtaacgtttcgttaaccg

SEQ ID NO: 341318 - DNA, 573 bp, Homo sapiens
  misc_feature: GZ8MTXP01ATCL6.51.64.F09.1.454.CMB.2.raw
  modified_base (197)..(197): a, c, t, g, unknown or other
  misc_feature (197)..(197): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (509)..(509): a, c, t, g, unknown or other
  misc_feature (509)..(509): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanacgccaccctctcctgcagggccagtcagagtgtttacaacacctagcctggtatcagcagagcctggccaggctcccaggcctcctcatctatggttcactcccgaccagggccnctgattcncccagtccctaggttcaggtcggactaggtggggctggggaaacagtaacttccactcctcaaccatcgagcacgtcctgctagttcgtaggtaaagttagttttagacttagtttattacttgtctagtactagtagtagtaataaggtcgtacctccgtattacgtttcggccgtaagggtaccgnggtcgttagggtaagtacgttaccgaaacggttacgtggtcggctcgaccacgtaattcgttcg

SEQ ID NO: 341319 - DNA, 643 bp, Homo sapiens
  misc_feature: GZ8MTXP01DR1SL.51.64.F09.1.454.CMB.2.raw
  modified_base (199)..(199): a, c, t, g, unknown or other
  misc_feature (199)..(199): n is a, c, g, or t
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaancgcccaccctctcctgcgagggccagtcagtagtgtttacaacactagcctggtancagcagagctggccaggctccagcctcnatctatgtcactccaccgagggccncgtagactactccccgagtcccgaggttcaggttcggacgtagggtcggggtcgtaggggaaacctagtaacttccacttcctacaaccctatcgacgtcacgcctagacgtagtactagtaagtttagtttcgtacttaagtttattacgtgtacgtaagtacgtaagttagtagtaagtaacggttcggtacccgttaccgttaccttacggttttccggacccgggttaacgggggacccgttaggggtaccgttagggaacgtaacgttaaccgttaaaacggttacggttcggtaggtccgttacgacccttaccgtaacttccgtttcg

SEQ ID NO: 341320 - DNA, 597 bp, Homo sapiens
  misc_feature: GZ8MTXP01E0SAH.51.64.F09.1.454.CMB.2.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagtagtgtttacaaacacctagcctggtatcagcagaagctggccaggctcccgagctcctnatctatgtcatccacgaggccntgactactcccgagcctaggttccaggtcggctagggtgggtctggggaaacagtaacttcactctacaccatcagcagcctgctagtctagtagttatttgacttagtttaattactgtacgagtctagttagtagtaagtaacggtcgtacccgttccgttaaccgttacgttttacgggaccggtaacgggggtaacccttaggggtaccgttagggaaagtaacttaacgttaaaacggttaaccgttgggacgtaacgtcggaccttaccgtaacttcgttccg

SEQ ID NO: 341321 - DNA, 633 bp, Homo sapiens
  misc_feature: GZ8MTXP01AZO3O.51.64.F09.1.454.CMB.2.raw
  modified_base (312)..(312): a, c, t, g, unknown or other
  misc_feature (312)..(312): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaagacgccaccctctcctgcagggccagtcagagtgtttacaaacactagcctggtatccccagcagacgctggccaggctccaggctcctcatctatggtcactccacgacgggccnctgactactcccgagccgtaggttcaggttcggcctagggtcgggtcgtacgggaaacagtaacttcacctctaccacctatcacgtcgacgtccgtgcgtacgttcgtaacggtaagttctttagtacgttaagttttaacttacgttgtacgagtacgtagttagtagtaagttacggttcgtacccgttaccggttaacgttaccggttttcgggaaccggtaacggggtaccgagggtccgttagggtaacgtaacgttaaccgttaaaacggttacgttggtacggcgtacgtaccgacgtaacttcgtttaaccg

SEQ ID NO: 341322 - DNA, 606 bp, Homo sapiens
  misc_feature: GZ8MTXP01DXKSM.51.64.F09.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaagggggaaanagccaccctctcctgcagggccagtcagtagttgtttacaaacaacctagcctggtatcagcagagctggcaggctccagctcctnatctatgtcactccacgaggccnctgactactccagcctaggttcaggtcgcaggtgggtctgggaacagtaacttcactctccacatcacgcacgtcngctagtactagtaagttagtttacgtacgttaagtttattacgttgttacgtagtacgtagttagtagtaagttaacggtacggtacccgttaccgttaacttacggtttacggaccgggtaacggggaaccgttttagggcggttagggaaacgtaacgttaacgaaacggttaacgttgggtacggtcgttcggaccttaccgtaacgttcgtttaaccg

SEQ ID NO: 341323 - DNA, 555 bp, Homo sapiens
  misc_feature: GZ8MTXP01C37IK.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagttgtttacaaacacctagcctggtatcagcagagctggcaggctccagctcctcatctatgtcatccaccgagggccnctgactacncccgagcctaggttcaggtcggcaggtgggtctgggaacagtaatcactctcacntcancagctgcagtctagtagtatttgacttagtttattactgtacagtcgtagttagtgtaagttaaggtcggtacccttacgtttacgtacggtttcggccggtaacggggtccgagggtcgttaggaacgtaacgttacgaaacgttaccgtggtacggcttcggaccttacctaacttcgtttcg

SEQ ID NO: 341324 - DNA, 584 bp, Homo sapiens
  misc_feature: GZ8MTXP01ELIHP.51.64.F09.1.454.CMB.2.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (381)..(381): a, c, t, g, unknown or other
  misc_feature (381)..(381): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaagggggaaanacgcccaccctntcctgcagggccagtcagtagttgtttacaaacacctagcctggtatcagnagagcctggccaggctcccagctcnatctatgtcatccacgagggccntgactactcccagcctaggttcagtcgctaggtgggtctgggaaacagtaacttcaactctacaccatcancacgctgcagtctagtaagttatttgacttagtttattactgtacagtctaagttatagtaagttaacgtcggtacccttaccgttacgttacgttttcgggaccggaacggggtaccgttacgggtcgttagggaacgtaacgttaaacggaaacgttaacgttgggtacggaacttcggaccttacctaacgttcgttccg

SEQ ID NO: 341325 - DNA, 568 bp, Homo sapiens
  misc_feature: GZ8MTXP01BU7EM.51.64.F09.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagttgtttacaaacacctagcctggtatcagcagagctggcaggctccgagctcnatctatgtcatccacaggcntgatactccagctaggttcagtcgcaggtggtctagggaacagtaactcactcacaccatcagcacgctgcagtctagtagttatttcgattagtttattacgtgtacgagtacgtagttatagtaatacggtcgtaccttacgttaccttacgtttacggccggtaaggggacccgagggtaccgttagggaaacgtaacgttaaccggaaaaccgttaacggtttcggacggtccgttacggccgttaaacgtctttcggtttccg

SEQ ID NO: 341326 - DNA, 583 bp, Homo sapiens
  misc_feature: GZ8MTXP01BVK33.51.64.F09.1.454.CMB.2.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagttgtttacaaacacctagcctggtatcagcagacgcctggccaggcctcccaggcctcctcatctatcggttcactccaccgagggccnctgatctcccagcctaggttcaggtcggcgtaggtgggtctgggaacagtaacttcacttctacaccatcgacgcacgctgctagtcgtagtaagttatttgacttagtttacttacttgtacagtactaagtagtagtaagtacggtcgtcccgttcgtacttcgtttcgggccggtaacggggaccgttagggtacgttagggtacgtacgttaaccgaaacgttacgtcggtcggtcgtacgccgttaacctcgttcgtttccg

SEQ ID NO: 341327 - DNA, 542 bp, Homo sapiens
  misc_feature: GZ8MTXP01BRQUX.51.64.F09.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
  modified_base (484)..(484): a, c, t, g, unknown or other
  misc_feature (484)..(484): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangcccaccctctcctgcagggccagtcagagtgtttcaacacctagcctggtatcagcagagcctggccaggctcccaggctcctnatctatgttcactccacgacgggccntgatctcccagccaggttcagtcggcaggtgggtctgggaacagaattcactctcactatcagcagcctgacngtctagacgttatttcgacttagtttacttacgtgttacgagtcgtagttagtgtaagttagtcggtccttaccgttacgtacgtttcggccggtaaggggacngggtcttggacgtacttacgaaacgttacgtgtcggctggaccttacctgttcgttcg

SEQ ID NO: 341328 - DNA, 590 bp, Homo sapiens
  misc_feature: GZ8MTXP01A9TK2.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgtttacaaacacctagcctggtatcagcagagcctggccaggcctcccgaggctcctcatctatggtcactccacgaggccnctgatactcccgagccaggttcaggtgcaggtggtctgggaacagtaatcactctcactancancacgctgctagtcgtagtaagttatttgtacttagtttacttacgtgtcgtagtcgtaagttagtagtaagttacgtcggtacccgtttaccgtacgttacgttttacgggaccggtaacgggggtacccgttagggtccgttaggaacggtaacgttaacgaaaaccgttacggtaacggtcgggtcttacggaccttaccgtaacttcgtttaaccg

SEQ ID NO: 341329 - DNA, 684 bp, Homo sapiens
  misc_feature: GZ8MTXP01CNU58.51.64.F09.1.454.CMB.2.raw
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (418)..(418): a, c, t, g, unknown or other
  misc_feature (418)..(418): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggcctcccagacaccacttgaacaaatagtgatgacgcagtctccaggcaccctgtctgtcgtctaccgaaggggaaacgcgcccaccctctccgtgcgacgggccagtcagtagttacgtttacaaacacctagtcctaggtatcgagtagacgccgtggccaggcctccgaggcctcctanattctagttcggtcacgtcccacgnggctgctagactcaccgagccgtaggtcaggtcggacgtaggtcgggtacgtacggggaaactagtaacttccacgtcctacgaccntacgagtacacgccgtgacgtacgttcgtaggttaacttgttttgactttaagtttactttacgtcggtaacagttcgtaaagttagtaggtaagttacggtcgttacccgttaccggttaacgttacggtttacgggccggggtaacgggtacccgttagggtccgttaaggggtaaaacgtcgttaaaacgggaaacccggttacgggttgggtacccgtaacggtcgtaaccgttaacccgttcgtttcgtttttaaccccgg

SEQ ID NO: 341330 - DNA, 586 bp, Homo sapiens
  misc_feature: GZ8MTXP01DQQYT.51.64.F09.1.454.CMB.2.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (282)..(283): a, c, t, g, unknown or other
  misc_feature (282)..(283): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctaccgaaggggaaancgcccaccctctccgtgcgagggccagtcagtagttgttacaaacacctagctggtancagnagagctgcngccncgngctcnntctntgtcatccacgnggctntgactcnccgagcctaggtcaggtggcngggtggcgtggaacagtctcactcacacctntcacgcacgctgactggttactaaggtagttatttgtattagtttattacgttggtctaaggtntaagttagtagagttacggtcgttacctacgttacgttacgtttacgggccggtaaacgggtcgttacgggtacgttagggacgtaacgttaaaccggttaaacgttaacggttcgtacgggtcgttaacggaccttaaacctcgtttccgtttaaccg

SEQ ID NO: 341331 - DNA, 605 bp, Homo sapiens
  misc_feature: GZ8MTXP01CJDEN.51.64.F09.1.454.CMB.2.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggaacaaatagtgatgacgcagtctccaggcaccctgtctgtgtctccgaagggggaaancgcccaccctctcctgcaggggccagtcagtagttcgtttacaaacaacctagcctggtatcagcagagctggccaggctcccaggctcctnatctatggttcatccacgagggccntgatactccagcctaggttcagtcggcaggtgggtcngggaacagtaactcactctcaccntcagcacgcctgacgtagtcgtagtaagtgtttgacttagtttatactgtactagtctaagtagtagtaacgttacggtcggttacccttaccgttaacgttaccgttttacgggcccggtaacgggggtacccgttaggggtaccgttagggtaaacgtacggttaaaccgaaacggttacgttgggtacggtaactcggacgttacctaacgttccgtttaacg

SEQ ID NO: 341332 - DNA, 609 bp, Homo sapiens
  misc_feature: GZ8MTXP01AT2PE.51.64.F09.1.454.CMB.2.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggccaccctgtctgtgtctccgaaggggaaancgcccaccctctcctgcacgggccagtcaggagttgtttactaaacaacctagcctggtatcagcagacgcctggccaggcctccaggctccncatctatgtcactccacgngggccntgactactcccgagtcccgtaggttcaggtcggcagggtgggtctagggaactagtaacttcgactctacacgtatcgagcagtcctgacctagtacgtaggtaagttatttcgacttagtttaacttacgtgtacgtgtacgtaagtagtaggtaataacggtcggtacccttaccggtacttacggtttacggccggtaacggggtaccgaggtccggttaggaacgtaacgacgttaaacggacgttggtacggtaacgttccgaccgttacctaagttccctttaacg

SEQ ID NO: 341333 - DNA, 621 bp, Homo sapiens
  misc_feature: GZ8MTXP01EW7YZ.51.64.F09.1.454.CMB.2.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggcctcccagacaccactggaacaaatagtgatgacgcagtctccaggcaccctgtctgtgtctccgaggggaaancgccaccctctcctgcagggccagtcagngttgttacaacaacctagcctggtatcagcagagcctggccaggctcccgnggtctccnatctatggtcnctccacgaggccntgatacnccagtccgtaggttcaggtcggctaggtcggggtactggggaaaactaggtaacttcaaccttctaccacctatcgacgctacgtcctgcgtagttcgttaagaagtttatttacgtattagtttacttacgtggttactaggtacgtaaggttataggtaaagtacggttcgtaccgttaccgttaacttccggtttacgggcccggtaagggggccttagggcgttagggtacgtaagttaaccgttaaacgttagttccggtggaaccgttcgggaaccttacctaacgtttcgttaacg

SEQ ID NO: 341334 - DNA, 595 bp, Homo sapiens
  misc_feature: GZ8MTXP01EZY37.51.64.F09.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttcaaacacctagcctggtatcagcagagcctggccaggctcccgggctccncatctatggttcatcccaccagggccgctgatatcccagccaggttcaggtggccaggtgggtctggggacaagaacttcactctcaccatcagcacgcctgcagtcngtaacgattttagctagtttattacgtgtcaggtcaaggttatagtagttaaacggtcgggtccccttaccggttaccgtaaccgttttcggggacccggtaagggggtaaccccaggggttccttaggggacgtaacgttaaccgaaaacgggttaaccttgggtcgggcttcgggacctaccccgatttcccggttgtttcccg

SEQ ID NO: 341335 - DNA, 633 bp, Homo sapiens
  misc_feature: GZ8MTXP01A0FAL.51.64.F09.1.454.CMB.2.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanacgccaccctctcctgcagggccagtcagtagtgtttacaacaacctagcctggtatcagcagaagcctggcccaggctcccaggctccncntctatggtcatcccacagggccnctgatactccccagtccaggttcaggtggcaggtggtctggaactgaattcgactctcaccatcacgctacgccgtcgcgtacgttctaggtaaagttagttttacgtaccgttaagttttaatttacgttacgttacgtaacggtacgtaagttaagttagtaaacgttaaggttcgggtcccttaccgttaccgttaacgttttccgggaccggtaacgggggtacccgttacggggtaccgttagggaaggtaacgttaacgaaaccggttaacttcggggttacgccgttcggacccttaccgtaacgttcgtttcg

SEQ ID NO: 341336 - DNA, 580 bp, Homo sapiens
  misc_feature: GZ8MTXP01B1A45.51.64.F09.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaangccaccctctcctgcagggccagtcagtagttgtttacaaacaacctagcctggtatcagcagacgcctggccaggctcccgaggctcctcatctatggtcactcccaccgngggccntgactactcccagcctaggttcaggtcggctaggtgggtctgggaaacagtaacttcactctaccacntcancagtcngcagtctagtaagtntttgacttagtttattacgtgtacgtacgtcgtaagtagtagtacgtaaggtcgtcccgttacgtacttacgtttcggccggtaacggggtacgagggtcgttaggacgtaacttaacgttaaacggttacgtaaggtcgggccttacggccttacgtaacgttccgttaacg

SEQ ID NO: 341337 - DNA, 486 bp, Homo sapiens
  misc_feature: GZ8MTXP01A04XI.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (365)..(365): a, c, t, g, unknown or other
  misc_feature (365)..(365): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctntcctgcagggccagtcagagtgtttcaacacctgcctggtatcagcagagctgcaggctccaggctctcatctatggtcatccacagggccnctgactactcccagtccaggttcaggtcggcaggtggtctggggaacagaacttcactctcactatcancagctgcagtctagaagtatttgcttagtttattactgtcatcgatatagatagtcgacctcgtactacgtttgcgaagggacnggcnggagtnacgaagactgtgctgcacctgttctcg

SEQ ID NO: 341338 - DNA, 606 bp, Homo sapiens
  misc_feature: GZ8MTXP01BS38B.51.64.F09.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatgtgatgacgcagtctccaggcaccctgtctgtgtctccgaggggaaancgccaccctntcctgccagggccagtcagattgtttacaacacctgcctggtatcgagcagacgcctggccaggctaccagctctnatctatggtcactccacgagggccntgactactccagtccaggtcaggtcggctagggtcgggtcaggggaactaggtaattccaacttcgtaccacgtatcagcacgctcgactagtcgtaagtagttatttgacttagtttattacgttcgtagtacgtacgtaagtaagtacgtaagtacgtcggttaccctaccggttaccgttacgtttacgggaccgtaagggggtaccgttacgggtcgttagggtaagtaacggttaaccgaaacggttacggtcgggtacgtccgtcggtaccttacgttaacttcgtttaaccg

SEQ ID NO: 341339 - DNA, 615 bp, Homo sapiens
  misc_feature: GZ8MTXP01CCLOL.51.64.F09.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (376)..(376): a, c, t, g, unknown or other
  misc_feature (376)..(376): n is a, c, g, or t
tcagcgatcgtatacacgaccggtgctcgatttagcgcgtatacaaggggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcgacgggccagtcagtagttgttacaacactagcctgtactcagcagacgctggcaggcctccgagcctcncatctagtgttcactcccaccgacggccactgactaccnccagcctaggttcaggtcggctaggtgggtcgtaggaacagtaactcactccncgacacgtcacgcgacgcctcgacgacgttcgtaagtagttagtttcgtacttaagtttacttacgtacgtacggtagtacgtaagttagtagtaacgttaacggtcgtacccgttaccgttaccgttacggttttcgggccggtaacggggaccgttacgggtcgttagggaacgtaacgttaaccgaaacgttacgttcgggtggtccgtacgacttacgtaacgttcgtttaaccg

SEQ ID NO: 341340 - DNA, 474 bp, Homo sapiens
  misc_feature: GZ8MTXP02F53FB.51.64.F09.1.454.CMB.2.raw
  modified_base (300)..(300): a, c, t, g, unknown or other
  misc_feature (300)..(300): n is a, c, g, or t
tcagcgatcgtatacacgaccggtgctcgatttagcgcgtatacaagggaggaactgctcagttaggacccagacggaaccatggaagcccagcgcagcttctcttcctcctgctactctggctcccagacaccactggacaaatagtgatgacgcagtctccaggcaccctgtctgtgtctccaggggaagagccaccctctcctgcagggccagtcagagtgtttctaacacctagcctggtatcagcagagcctggccaggctcccaggctcctcatctatggtcatccacaggccnctgatatcccagccaggttcagtgcagtgggtctgggacagattcactctcaccatcagcagcctgcagtctgagatttgctagttattactgtcagcagtatgatagtggcctcgtacacgtttgcctaggggaccaggctggagatacaaacgaactgtgctgcaccatctg

SEQ ID NO: 341341 - DNA, 486 bp, Homo sapiens
  misc_feature: GZ8MTXP02HE8DN.51.64.F09.1.454.CMB.2.raw
  modified_base (196)..(196): a, c, t, g, unknown or other
  misc_feature (196)..(196): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacaacctagcctggtatcagcagaagcctggccaggctcccaggctcctcatctatggttcatccaccaggccgctgatatcccagccaggttcagtggcagtgggctgggacagattcatctcaccatcagcagcctgcagtctgagatttgctagttatactgtcagcagtatagataagtggcctcgtactactttgcctaggggaccaggctggagactacaaacgaactgtaggctgacacctatctg

SEQ ID NO: 341342 - DNA, 505 bp, Homo sapiens
  misc_feature: GZ8MTXP02HDVFM.51.64.F09.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttctaacacctagcctggtatcagcagagcctggccaggctcccaggctcctcatctatggttcatccacaggccnctgatactcccagccaggttcagtcggcaggtggtctgggacagattcactcncaccntcancancctgcagtctagagtatttgactagtttattactgttacagtcagtatagataagtggcctcgtactacgtttggaccgtacggggaccgaggcgtaggacgagtacaaacgaactgtcgctacgacactactctcg

SEQ ID NO: 341343 - DNA, 496 bp, Homo sapiens
  misc_feature: GZ8MTXP02JC1OK.51.64.F09.1.454.CMB.2.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacaacctagcctggtatcagcagagcctggccaggctcccaggctcctcatctatgtcatccacaggccntgatatcccagccaggtcagtgcagtggctgggacagatcactcncacatcagcagcngcagtntganattagtctattattactgtctagacagtatagtataagtagtcgtacgtactacgtttcgtcgacgggacgacggacgtaggagatacgaaacgaaacgtaagtaggcgtacgacacactactcg

SEQ ID NO: 341344 - DNA, 506 bp, Homo sapiens
  misc_feature: GZ8MTXP02JHAJC.51.64.F09.1.454.CMB.2.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttctaacacctagcctggtatcagcagagcctggccaggctcccaggctcctcatctatggttcatccacagggccnctgatactcccagccaggttcagtcggcagtggtctgggacagattcactctcaccatcagcagccctgcagtctagaagtattttgctagtttattactgtcagcagtatgataagtgcctcgtactactttggcctacgggggaccaggtccgtaggagactacgaaacgtaacgtgtaggctcggactaccatcttcg

SEQ ID NO: 341345 - DNA, 517 bp, Homo sapiens
  misc_feature: GZ8MTXP02JXO9K.51.64.F09.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccaggcaccactggacaaatagtgatgacgcagtctccaggcaccctgtctgtgtctccaggggaaanagccaccctctcctgcagggccagtcagagtgtttcaacacctagcctggtatcagcagagcctggccaggctcccaggctcctnatctatggttcatccacagggccnctgatactcccagccaggttcagtcggcaggtggtctggggacagattcactctcaccatcagcagcctgcagtctagagtatttgctagtttattactgtcagctagtatagatagtggtccttcgtactacgtttcggccgtacggggaccgaggcgtaggacgacgtacgaaacgtacgtaaggtcggacgtcgacctacgtactctcg

SEQ ID NO: 341346 - DNA, 515 bp, Homo sapiens
  misc_feature: GZ8MTXP02IS908.51.64.F09.1.454.CMB.2.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacacctagcctggtatcagcagaagcctggccaggctcccaggctcctcatctatggttcatccacagggccntnatntccagccaggtcagtgcagtggtctggacagattcactcncaccatcagcagcctgacagtctagtaagtattttgactagtttattactgtcagcagtatagaataagtgtcctaccgtactacgtttcggacgtacgggacgaggcgtaggacgacgtaacgaaacgaaacgtaaggtggtacgtacgacgactactactcg

SEQ ID NO: 341347 - DNA, 515 bp, Homo sapiens
  misc_feature: GZ8MTXP02GVCDK.51.64.F09.1.454.CMB.2.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctctcctgcagggccagtcagagtgtttcaacaacctagcctggtatcagcagaagcctggccaggctcccaggctcctcatctatggttcatccaccagggccnctgatactcccagccaggttcagtcggcagtgggtctggggacagattcactctcaccatcagcagcctgcagtctagaagtatttgactagtttattactgtacagtcagtatgaataagtggtcctcgtactacgtttggccgtacggggaccgaggtcgtgggagacgtacaaaacgacgtaagtggactcgaccactactactcg

SEQ ID NO: 341348 - DNA, 522 bp, Homo sapiens
  misc_feature: GZ8MTXP02IZ1I9.51.64.F09.1.454.CMB.2.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagcgatcgtatacacgaccggtgctcgatttagcgcgtatacaaggggaggaactgctcagttaggacccagacggaaccatggaagcccagcgcagcttctcttcctcctgctactctggctcccagacaccactggacaaatagtgatgacgcagtctccaggcaccctgtctgtgtctccaggggaaangccaccctctcctgcagggccagtcagagtgttcaacacctgcctggtatcagcagagcctggccaggctcccaggctcctnatctatggtcatccacaggcccntgactctcccagcctaggttcagtcgctaggtggtcnggacagtattcactcncacagtcancagctgcagtntagagtatttgactagtttattactgtcagctagtatagaagttaggtcggtacctacgtacgttacgtttcggaccgtacggggacaggtcgtaggacgtacgtaacgaaacgtacgtggtacgtacgtcgacctacgtacgttcgtcg

SEQ ID NO: 341349 - DNA, 534 bp, Homo sapiens
  misc_feature: GZ8MTXP02JFL3M.51.64.F09.1.454.CMB.2.raw
  modified_base (193)..(193): a, c, t, g, unknown or other
  misc_feature (193)..(193): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
tcagcgatcgtatacacgaccggtgctcgatttagcgcgtatacaaggggaggaactgctcagttaggacccagacggaaccatggaagccccagcgcagcttctcttcctcctgctactctggctcccagacaccactggacaaatagtgatgacgcagtctccaggcaccctgtctgtgtctccagggaangccacctctcctgcagggccagtcagagtgtttcaacacctagcctggtatcagcagagcctggccaggctcccaggctctcatctatggttcatccacagggccnctgatatccccagccaggttcagtcggcaggtggtctgggacagacttcactctacaccatccancacgcctgcagtctagaagttatttgctagtttattacgtgtacagtctagtatagtagtaagtcgtacctcgtacgtacgtttcggaccgtacggggacctagggaccgtgggaacgtacgtaacgaaaacgtaacgtggtacggtactcggacctacctagtcttacg

SEQ ID NO: 341350 - DNA, 546 bp, Homo sapiens
  misc_feature: GZ8MTXP02HG0NN.51.64.F09.1.454.CMB.2.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacaacctagcctggtatcagcagaagcctggccaggctcccaggctcctcatctatggttcatcccaccagggcccnctgatactccagccaggttcagtcggcagtgggtctgggacagattcactctcaccatcagcagcctgcagtctagaagtattttgctagtttattactgtacagtctagttatagaagtaagtcggtcccttaccgtactacgttttcgggaccgtacgggggaccctagggcctagggaacgtactaccgaaaacgtacgtggtacggacctcggaccaccctattccttcgg

SEQ ID NO: 341351 - DNA, 514 bp, Homo sapiens
  misc_feature: GZ8MTXP02I4EFU.51.64.F09.1.454.CMB.2.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctctcctgcagggccagtcagagtgtttctaacacctagcctggtatcagcagancctggccaggctcccaggctcctnatctatggttcatccacagggccnctgatatcccagccaggttcagtcgcagtgggtctggggacagattcactctcaccatcgagcagcctgcagtctagagtatttgctagttattactgttcagtntagtatagatagtcgtccttcgtacttacgtttcggacgacgggactaggcgtaggacgtacgtacgaaacgtacgtggtacgcgtacgacctactacttcgtcg

SEQ ID NO: 341352 - DNA, 515 bp, Homo sapiens
  misc_feature: GZ8MTXP02I6OGA.51.64.F09.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagttgtttcaacaacctgcctggtatcagcagagcctggccaggctcccaggctccnatctatgttcatcccacgagggccntgatactcccagccaggttcaggtcgcaggtgggtctgggacagattcactcncaccatcagcagcctgcgagtctagaagtatttgactagtttattactgtcagtctagtatagtatagtcgtcctcgtactacgtttcggcgtacgggacgaggcgtaggagtacgtaacgaaacgtaacgtgtacggctacgacactactcttcg

SEQ ID NO: 341353 - DNA, 506 bp, Homo sapiens
  misc_feature: GZ8MTXP02I2PZS.51.64.F09.1.454.CMB.2.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgtttcaacactagcctggtatcagcagagcctggccaggctcccaggctcctcatctatggttcatcccacagggccnctgatatccccagccaggttcagtcggcagtgggtctgggacagattcactctcaccatcagcagcctgcagtctgagtatttgctagtttattactgtcagtcagtatagagtagtgtcgtccgtactacgtttcggacgtacgggacgaggcgtggacgtacgtacgaacgtacgtgtcggacgtcgacacctactctcg

SEQ ID NO: 341354 - DNA, 501 bp, Homo sapiens
  misc_feature: GZ8MTXP02JVVM2.51.64.F09.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaaacacctagcctggtatcagcagagcctggccaggctcccaggctctcatctatgtcatccacaggccntgatactccagccaggttcagtcgcagtggtcnggacagattcactcncacatcancagctgcagtctagaagtatttgtactagtttattactgtacagcagtatagagtaagtcggctcgtactacgtttcgacgtacgggacaggcgtaggagacgtacgaaacgacgtgtacggtactcggacactacgtctttcg

SEQ ID NO: 341355 - DNA, 554 bp, Homo sapiens
  misc_feature: GZ8MTXP02JIX1O.51.64.F09.1.454.CMB.2.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgttcaacacctagcctggtatcagcagagcctggccaggctcccaggctcctcatctatggttcatccaccnggccntgatactccagccaggttcagtcggcaggtggtctgggacagtacttcactctcaccatcagcatcctgctagtctagtaagtatttgacttagtttattactgtacgagtactagttagtagaagttaacgtcggtcctaccgttacgtacgttttcggaccgtacgggggacctagggtccgtagggaacgtacgttaacgaaaccgtaacgtggtacgggtctacggtaccaacctactacgtttcg

SEQ ID NO: 341356 - DNA, 509 bp, Homo sapiens
  misc_feature: GZ8MTXP02IN7VI.51.64.F09.1.454.CMB.2.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacaacctagcctggtatcagcagaagcctggccaggctcccaggcctcctcatctatggttcatcccaccagggccnctgatactcccagccaggttcaggtcggcaggtgggtctgggacagattcactctcaccntcagcagcctgcagtctagaagtatttgactagtttattatgtcagtcagttatgtataagtggcctcgtactacgtttggaccgtaggggaccagggctaggacgtactacaaagactaagtcgctcgacaccatctcg

SEQ ID NO: 341357 - DNA, 568 bp, Homo sapiens
  misc_feature: GZ8MTXP02G853A.51.64.F09.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacactagcctggtatcagcagagcctggccaggctcccaggctccncatctatggttcatccacagggccntgatactccagccgtaggttcaggtcggctaggtgggtcgtgggacagtattcactcctacaccatcancacgcctgctagtcgtagtaagttatttagtacttagtttacttacgtgtactagtacgtagttagtagtaagttacgtcggtaccgttaccgttacgttacgtttcggaccggtacggggaccgaggtcgtacggaacgtacgtaaccgaaacgtaacgtggtacggtacgtacgaccgtaccgtactcgttcg

SEQ ID NO: 341358 - DNA, 536 bp, Homo sapiens
  misc_feature: GZ8MTXP02HBR8Q.51.64.F09.1.454.CMB.2.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccacctctcctgcagggccagtcagagtgtttcaacacctagcctggtatcagcagagcctggccaggctccagctctnatctatgtcatccacaggccnctgactactcccagcctaggttcagtcggcaggtggtctgggacagattcactctcacctatcagcagcctgcagtctagagtatttgactagttattactgtcagtctagtatgtagttaagtcggtctaccgttactacgttttcggaccgtacggggaccgtaggtcgtaggaacgtagtacgaaaacggtaacgttggtagggtaccttacggaccgtaccctattaccgtttccg

SEQ ID NO: 341359 - DNA, 505 bp, Homo sapiens
  misc_feature: GZ8MTXP02G5QA9.51.64.F09.1.454.CMB.2.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaaggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacacctagcctggtatcagcagagcctggccaggctcccaggctccncatctatggtcatccaccagggccnctgatactcccagccaggttcagtcgcagtggctgggacagattcactctcaccatcagcagcctgcagtctagagtattttgactagtttattactgtcagtctagtatagatagtcgcctcgtactacgtttgccgtacgggaccaggtctaggagtactacgaaacgtactggtacgctacggcaccgtatcttacg

SEQ ID NO: 341360 - DNA, 511 bp, Homo sapiens
  misc_feature: GZ8MTXP02I7YH1.51.64.F09.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (385)..(385): a, c, t, g, unknown or other
  misc_feature (385)..(385): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttcaacacctgcctggtatcagcagaagcctggccaggctccaggctcctcatctatggttcatccacagggccntgatactcccagcctaggttcagtcggctaggtggtctgggacagattcactctacacatcagcagcctgcagtctagaagtntttgctagtttattactgtcagcagtatagagtagtcggcctcgtactacgtttgaccgtacgggaccaggcgtaggacgactacgaaacgtaacgtggtacggctacgacctactactcgttacg

SEQ ID NO: 341361 - DNA, 527 bp, Homo sapiens
  misc_feature: GZ8MTXP02FMX3B.51.64.F09.1.454.CMB.2.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgtttcaacacctagcctggtatcagcagagcctggccaggctcccaggctcctcatctatggttcatccacgagggccnctgatactcccagccaggttcagtcggcagtggtctgggacagtattcactctcaccatcagcagcctgcagtctgagtatttgctagtttattactgtcagctagtatagataagtcggcctcgtactacgtttcggccgtacggggaccgaggtcgtagggacgtacgtaccgaaacggtaacgtggtacggtcgtacggaccgtacctacgtcgtttcg

SEQ ID NO: 341362 - DNA, 548 bp, Homo sapiens
  misc_feature: GZ8MTXP02G4H61.51.64.F09.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttcaacacctgcctggtatcagcagaancctggccaggctcccaggcctcctcatctatggttcatccacgagggccnctgactactcccagcctaggttccaggtcggcaggtgggtctgggactagacttcactctcacatcagcacgctgcagtctagtagtatttgacttagtttattacttgtacagtacgtagtatagtagtaagtcggtacctaccgttacgtacgtttacggccggtacggggaccgtagggtcgtaggacgtagtaccgaaacgtaacgtggtcggtacgtcgacctaccgtacgtctttcg

SEQ ID NO: 341363 - DNA, 527 bp, Homo sapiens
  misc_feature: GZ8MTXP02GP7DK.51.64.F09.1.454.CMB.2.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacaacctagcctggtatcagcagancctggccaggcctcccaggctcctnatctatggttcatccaccgagggccntgatactcccagccaggttcagtcgcagtgggtctgggacagattcactctcaccntcancagcctgcagtctagaacgtntttgactagtttattattgtacagtctagtatagtatagtcgtcctccgtactacgtttcggaccgtacgggaccgtaggcgtaggacgtacgtacgtaaacgtaacgtggtacggtctacgcaccgtactcgttacg

SEQ ID NO: 341364 - DNA, 490 bp, Homo sapiens
  misc_feature: GZ8MTXP02IO36E.51.64.F09.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagcgatcgtatacacgaccggtgctcgatttagcgcgtatacaaggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagttgtttctaacaacctagcctggtatcagcagaagcctggccaggctcccaggctcctnatctatggttcatccaccaggccnctgatactcccagccaggttcagtcgcagtggtctgggacngattcatctcaccatcagcagcctgcagtctagaagtattttgctagtttattactgtcagtcagttatgatagtgcctcgtactactttgcctaggggccaggctgganatacaaagactgnggctcgacacctatcttcg

SEQ ID NO: 341365 - DNA, 512 bp, Homo sapiens
  misc_feature: GZ8MTXP02HM4GJ.51.64.F09.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacaacctagcctggtatcagcagaagcctggccaggctcccaggctcctcatctatggttcatccacagggccnctgatactcccagccaggttcagtcggcagtgggtctgggacagattcactctcaccatcancagcctgcagtctagaagtattttgctagtttattactgttcagtcagtatgatagtggcctcgtactacgtttgccgtacggggaccaggcgtgggacgacgtacaaacgacgtggtacggctacgaccacctactcttcg

SEQ ID NO: 341366 - DNA, 562 bp, Homo sapiens
  misc_feature: GZ8MTXP02ILZK2.51.64.F09.1.454.CMB.2.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctctcctgcagggccagtcagagtgtttcaacactagcctggtatcagcagagcctggccaggctcccaggctcctnatctatggtcatccaccgagggccnctgatactcccagccaggttcaggtcggctaggtgggtctgggacagattcactctcaccatcagcagcctgcagtctagtaagtagtttgtactagtttattacgttgttacgagtctaagttatagtaagttaacgtcggtcccttacggtacttacgttttggacccgtacgggggtacccgagggtcgttagggaacgtacgtaaccgtaaacgtaacgttaaggtcggacgttcggacctacctactcgttacg

SEQ ID NO: 341367 - DNA, 527 bp, Homo sapiens
  misc_feature: GZ8MTXP02JLYLZ.51.64.F09.1.454.CMB.2.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttctaacaacctagcctggtatcagcagaagcctggccaggctcccaggctcctcatctatggttcatccacnggccntgatntcccagccaggttcagtggcaggtggtctgggacagattcactctcaccatcagcagctgcagtctagagtatttgactagtttattactgtcagtactagttagtagtataggtcgtacctcgtactacgtttcggccgtaggggaccgtaggtcgtagggacgtacgtacgaaacgtaacgtggtacggaccttggacctaccgattccgttacg

SEQ ID NO: 341368 - DNA, 548 bp, Homo sapiens
  misc_feature: GZ8MTXP02HA9PZ.51.64.F09.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttacaacacctagcctggtatcagcagagcctggccaggctcccaggctcctnatctatgtcatccacgaggccnctgatactcccagcctaggttcagtcggctaggtgggtctgggacagtattcactctacaccatcagctacgcctgcgtagtcgtagtaagtagttttgtacgttagtttacttaacgttgttactagtactagtatagtaagtagtcgtaccttcgtacttacgtttcggaccgtacggggacgacggtcgtaggacgtacgtaacgaaacgtaacgtggtcgcgtacgacaccgtactctcg

SEQ ID NO: 341369 - DNA, 516 bp, Homo sapiens
  misc_feature: GZ8MTXP02GK0KJ.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagagtgttcaacacctgcctggtatcagcagagcctggccaggctccaggctcctcatctatggtcatcccacagggccnctgatactcccagccaggttcagtcggcagtgggtctgggacagattcactctcaccatcagcagcctgcagtctagaagtnttttgctagtttattactgtcagtntagtatgagtagtcggtacctcgtactacgtttcgcgtaggggaccaggtcgtaggacgtacgtacgaaacgtaacgtggtcggactcggacctaccgtacttcgtcg

SEQ ID NO: 341370 - DNA, 568 bp, Homo sapiens
  misc_feature: GZ8MTXP02H52YI.51.64.F09.1.454.CMB.2.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgtttcaacacctagcctggtatcagcagaagcctggccaggctcccaggctcctnatctatggttcatccaccngggccntgatactcccagccaggttcagtcggcaggtgggtctggggacagtattcactctacaccatcagcagcctgcagtctagaagtatttgacttagtttattacttgtcagtctagtatagtaattaaggtcggtcctaccgttacctacgttttcgggaccgtaacgggggtaccgagggtccgttagggaacgtacgtaaccgtaaaacggtaaccgttgggtacggtccgtacggaccgtaccctaacgttccgtttacg

SEQ ID NO: 341371 - DNA, 538 bp, Homo sapiens
  misc_feature: GZ8MTXP02JVSYE.51.64.F09.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagttgtttacaacacctgcctggtatcagcagagcctggccaggctcccgaggcctcctnatctatgtcatccacgnggccntgatacncccagcctaggttcaggtcggctaggtgggtctggggacaggtacttcgactctacactatccagcacgcctgcagtctagagtatttgacttagtttattactgttacagtactagtatagaagtagtcgtccttcgtacttacgtttggcgtacggggacgaggtcgtagggactacgtacgaaaacgtacgtggtacgtacgtcgaccgtacctagtcttcg

SEQ ID NO: 341372 - DNA, 515 bp, Homo sapiens
  misc_feature: GZ8MTXP02IMBJE.51.64.F09.1.454.CMB.2.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (300)..(300): a, c, t, g, unknown or other
  misc_feature (300)..(300): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaaacaacctagcctggtatcagcagancctgccagctccagctccnatctatgtcatccaccaggccntgatatcccagccaggttcagtggcagtggtctgggacagattcactctacaccatcagcagcctgcagtctagaagtattttgactagtttattactgtacagtctagttatagaagtaagtcggccttacgtacttacgtttggccgtaaggggaccgtagggctagggaagactaaccgaaacgaaacgtgtacggctcgacacctatcttg

SEQ ID NO: 341373 - DNA, 506 bp, Homo sapiens
  misc_feature: GZ8MTXP02GI7QV.51.64.F09.1.454.CMB.2.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctctcctgcagggccagtcagagtgtttcaacaacctagcctggtatcagcagagccngcagcnccagctctcatctatgtcatccacgagggccntgatactccagccaggttcagtcgctagtggtctgggacagtatcactctcaccatcancancctgcagtctagtagtatttgactagtttattactgtcagtctagttagtgtaatagtcgtacctcgtactacgtttcggaccgtacgggacgaggcgtaggactacgtacgaaacgaacgtgtacgctacgactacgtactctacg

SEQ ID NO: 341374 - DNA, 540 bp, Homo sapiens
  misc_feature: GZ8MTXP02HA4EV.51.64.F09.1.454.CMB.2.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacacctagcctggtatcagcagagcctggccaggctcccaggcctcctcatctatggtcatccacgaggccgntgatactcccagccaggttcagtcggctaggtggtctgggacagacttcactctacaccatcagcagccctgcagtctagaagtattttgacttagtttattacgtgttacagtacagttatagaagttaaggtcggtcctaccgtacttacgttttcggccgtacgggggaccagggtcgtagggagtacgtaccgaaacggtaacgtggtacggctacgacacctactcgtcg

SEQ ID NO: 341375 - DNA, 602 bp, Homo sapiens
  misc_feature: GZ8MTXP02HAMUN.51.64.F09.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagttgttacaacacctagcctggtatcagcagagcctggccaggcctccagctctnatctatgtcatccacgnggccntgactactcccagtcctaggttcagtcggacaggtcggggtctggggacagtacttcacttctacacctatccagcacgccctgcagtctagaagttatttgacttagtttactttaacgtgtactacgtacgtagttagtagtaagttaacggtcgggttaccttacccggttaaccgttacggttttacggacccggtaacgggggtacccgtagggtaccgttagggaacgtaacgtaaccggtaaaaccggttacgtaaggtacggtacgtcggaccgtacctacgttctttacg

SEQ ID NO: 341376 - DNA, 610 bp, Homo sapiens
  misc_feature: GZ8MTXP02G9H5G.51.64.F09.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagttgtttcaacacctagcctggtatcagcagagcctggccaggctcccgaggcctcctnatctatcggttcatccacgagggccntgactactcccagcctaggttcagtcggctaggtggggtctaggggacagtacttccactctacaccatcgancagccctgcagtcgtagaagtatttgactagtttattactgttacagtctagtatagtagttaacgtcggtacccttacgttaacgttaccggttttacggacccggtaacgggggtacccgtagggtaccgttaggggaaacggtaacgtaaaccggtaaaacggttaacgttcgggttacggggtccgttacgggtaccgtaacccgttaacttaccgtttaccgg

SEQ ID NO: 341377 - DNA, 521 bp, Homo sapiens
  misc_feature: GZ8MTXP02J18X1.51.64.F09.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccagggaaanagccaccctntcctgcagggccagtcagagtgttcaacacctagcctggtatcagcagancctgccagctccaggctcncatctatggttcatccacgaggccnctgatntcccagccaggttcagtcggcaggtgggtctgggacagatcactctcaccatcagcacgcctgcagtctagagtattttgacttagtttattacgtgtcagcagtagtagtagtaaggtcggtaccttcgtactacgtttacgggccgtacggggacctaggcgtaggtagtacgtacgtaaacgaacgtggtacgacgtcgaccactactcttcg

SEQ ID NO: 341378 - DNA, 523 bp, Homo sapiens
  misc_feature: GZ8MTXP02G7UZX.51.64.F09.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (352)..(352): a, c, t, g, unknown or other
  misc_feature (352)..(352): n is a, c, g, or t
  modified_base (413)..(413): a, c, t, g, unknown or other
  misc_feature (413)..(413): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccacctctcctgcagggccagtcagagtgtttacaaacacctgcctggtatcagcagagcctggccaggctcccaggctccncatctatgttcatccacaggccntgactatccagccaggtcagtcggcagtggctgggacagacttcactcncaccatccgagcagccctgctagtctagaagtattttgcttagtttattacgtgtacagtnaagttagtagataaggtcggtcctacgttactacgtttggtcgtaacggggtaccgagggtctagggacgtagtacgaaagtaacgtgtcggtctcggacactctcgtcg

SEQ ID NO: 341379 - DNA, 534 bp, Homo sapiens
  misc_feature: GZ8MTXP02JV4QX.51.64.F09.1.454.CMB.2.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagngtgttctaacacctagcctggtatcagcaganctgcaggctccaggctctnatctatgtcactccacgngggccnctgatactcccagcctaggttccagtcggcaggtcgggtcgtaggggacaggtacttccactctacacctatcagcagcctgcagtctagtagttatttgacttagtttattactgtactagatagtatagagtagtcgtacctacgtacgtacgtttcgcgtacgggaccgaggtcgtaggacgtactaacgaaacgtacgtaagtcggtactacgactacctactacgttcg

SEQ ID NO: 341380 - DNA, 505 bp, Homo sapiens
  misc_feature: GZ8MTXP02FJ7P0.51.64.F09.1.454.CMB.2.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacacctagcctggtatcagcagancctggccaggctcccaggctcctcatctatggttcatccaccagggccnctgatatcccagccaggttcagtcggcaggtgggtctggggacagattcactctcacatcagcagcctgcagtctgaagtattttgctagtttattactgtcagcagtatgatagtgcctcgtactacgtttgcgtacgggaccaggcgtggaagacgtacgaaacgaacgtggtaggcgtcgactaccgactcttcg

SEQ ID NO: 341381 - DNA, 609 bp, Homo sapiens
  misc_feature: GZ8MTXP02JU8YA.51.64.F09.1.454.CMB.2.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanacgccaccctctcctgcagggccagtcagagttgtttcaacaactagcctggtatcagcagagcctggccaggctcccaggcctcctcatctatgtcatccacagggccntgatactccagccaggttcaggtcggctaggtgggtctggggacagacttcactctacacatcacgcagcctagctacgtcgtagtaagtatttttagacgttagtttactttacgtgttaccgtagtacgtaagttagttagaaagtttaaacggtcggtacccgttaccggttaaccgtttaaccggtttttcggacccggtaacgggggtaaccccgtaggggtaccgttagggaagtaacgtaaccgtaaaacggtaacgttggttacggaccgtacggacctactacgtcctttacg

SEQ ID NO: 341382 - DNA, 556 bp, Homo sapiens
  misc_feature: GZ8MTXP02H24VI.51.64.F09.1.454.CMB.2.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcacctgtctgtgtctccaggggaaanagccaccctctcctgcagggccagtcagagtgtttcaacaacctagcctggtatcagcagacnctggccagcctccaggctcctcatctatgttcatccacgagggccnctgatactcccagcctaggttcaggtcggcaggtcgggtctggggacagtacttcactctcaacntcancagcctgcagtctagaatatttgacttagtttatacgtgtcaggtctagtatagtagtaagtcggtacctacggttaacttcgtttacggacccggtaggggacccgtgggacgttaggacgtaacgtaccgaaaacggtaacgtcggtcggtacgttccggactaccgtaacgttacttccg

SEQ ID NO: 341383 - DNA, 555 bp, Homo sapiens
  misc_feature: GZ8MTXP02JF0IQ.51.64.F09.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagtgtttacaacacctgcctggtatcagcagagcctggccaggctcccagctccncatctatgtcactccacgagggccntgactactcccagccaggttcaggtccgacnggtggtctgggacagnttcactctccacatcagcagcctgcagtcgtagaagttattttgacttagtttattacctgtacaggtactaggttatagaattacgtcggtcctccggttactacgtttcggacgtacgggggacctaagggtccgtagggaacgtaacgtaaccgaaaacgtaacgtggtacggaccttcggacctaccgtacttctttcg

SEQ ID NO: 341384 - DNA, 524 bp, Homo sapiens
  misc_feature: GZ8MTXP02G2O1P.51.64.F09.1.454.CMB.2.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacacctgcctggtatcagcagagcctggccaggctccagctccncatctatgtcatccacgaggccnctgactactcccagccaggttcagtgcagtgggtctgggacagacttcactctacactatcagcagcctgctagtctagaagtatttgactagtttattacttgtcagtcagttatagattaagtcgtcctccgtactacgtttcggaccgtacggggacctagggcgtaggacgtacgtaaccgaaacggtaactggtacggactacgacacctatacgtttcg

SEQ ID NO: 341385 - DNA, 528 bp, Homo sapiens
  misc_feature: GZ8MTXP02H9I2N.51.64.F09.1.454.CMB.2.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaangccaccctctccngcagggccagtcagagtgtttcaacacctagcctggtatcagcagagcctggccaggctccagctccnatctatgtcatccacnggccntgatctcccagcctaggtcagtcgcaggtggtctgggacagtacttcactctcaccatcagcagcctgctagtctagtaacgttatttgacttagtttattacgtgttcagtctagtatagtataaggtcgtccttaccgtattacgtttggacgtacggggacctagggtcgtagggaagtacgtaaacgaacggtaacgtggtcggctacgactaccgtacgttcttcg

SEQ ID NO: 341386 - DNA, 496 bp, Homo sapiens
  misc_feature: GZ8MTXP02IPQCM.51.64.F09.1.454.CMB.2.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttcaacacctagcctggtatcagcagaagcctggccaggctccaggctcctcatctatggttcatccaccagggccntgatactcccagccaggttcagtgcagtggtctgggacngattcactctcaccatcagcagctgcagtctgagtatttgctagttattacttgtcagtcagtatgtagtgctcgtactacgtttgcgagggtaccgaggtcgtggagacgtacaaacgtaacgtggtgtactcgacactactcgtcgttcc

SEQ ID NO: 341387 - DNA, 531 bp, Homo sapiens
  misc_feature: GZ8MTXP02GX8K3.51.64.F09.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaacaacctgcctggtatcagcagagcctggccaggctccgagctccncatctatgttcatccacaggccntgatactcccagccaggttcagtcggcagtggctgggacagattcactctcacctatccagcacgcctgactagtcgtagaacgttatttgacttagtttattacttgtacagtctagtatagtagttaagtcggtacctcgtacgttacgtttcggaccgtaacggggacctaggcgtaggagtactacgaaacgtacgtggcgtactgacctacgtactcgttacg

SEQ ID NO: 341388 - DNA, 545 bp, Homo sapiens
  misc_feature: GZ8MTXP02IPRFO.51.64.F09.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttcaacactagcctggtatcagcagagctggccaggctcccaggctcctcatctatgttcatccaccgaggccntgatactcccagccaggttcaggtcgcagtgggtctgggacagattcactctacaccatcgagcagcctgctagtctagaacgtatttgacttagtttattacttgtaccagtactagttatagtagttaaggtcggtacctaccgttacttacgttttcggaccgacggggaccgagggtcgtagggagtacgtaaccgaaacgtaaacgtgtacggtcgtacgacctaacctacttacgtcg

SEQ ID NO: 341389 - DNA, 525 bp, Homo sapiens
  misc_feature: GZ8MTXP02F7CBN.51.64.F09.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctntcctgcagggccagtcagagtgtttcaacacctagcctggtatcagcagagcctggccaggctcccagctcnatctatgtcatccacnggccnctgatactcccagccaggttcagtgcngtggctgggacagtatcactctcaccatcagcagcctgctagtctagagtattttgacttagtttattactgtcagtcgagttatagataacgtggtcctcgtactacgtttggaccgtaacggggacccaagggtcgtagggaacgtacgtaaccaaacggtaaactggtcggcttacggacctactaacttcgttcg

SEQ ID NO: 341390 - DNA, 536 bp, Homo sapiens
  misc_feature: GZ8MTXP02JYF2M.51.64.F09.1.454.CMB.2.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
tcagcgatcgtatacacgaccggtgctcgatttagcgcgtatacaagggggaggaactgctcagttaggacccagacggaaccatgggaagccccagcgcagcttctcttcctcctgctactctggctcccagacaccactggacaaatagtgatgacgcagtctccaggcaccctgtctgtgtctccaggggaangccacctctcctgcagggccagtcagagtgtttcaacacctagcctggtatcagcagaagcctggccaggctcccaggctcctcatctatggttcatcccacgagggccnctgatactcccagccaggttcagtcgctaggtcgggtcaggggacagtacttcactctacaccatcagcagcctgctagtcgtagaagtntttgactagtttattactgtcagtcagtagtagagtaagtcggtaccttccgtactacgttttcggaccgtacggggaccgaggcgtagggacgtaacgtacgaaacgtacgtggtacgcgtcggacactacgtacgtcg

SEQ ID NO: 341391 - DNA, 549 bp, Homo sapiens
  misc_feature: GZ8MTXP02JOH2A.51.64.F09.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgtttctaacaacctagcctggtatcagcagagcctggccaggctcccgagcctcncatctatgtcatccacngggccntgatactcccagcctaggttcagtcggctaggtgggctgggacagtattcactctcacatcagcagcctgctagtcgtagacgttattttgacgttagtttacttactgtactacgtcgtagtatagtaattaaggtcggtacctacgttacgttacgtttacggaccgtacggggaccgagggtcgtagggacgtacgtaacgaaacgtacgtcggtcgtacgtcgacacctacgtacgtttcg

SEQ ID NO: 341392 - DNA, 641 bp, Homo sapiens
  misc_feature: GZ8MTXP02JQILS.51.64.F09.1.454.CMB.2.raw
  modified_base (196)..(196): a, c, t, g, unknown or other
  misc_feature (196)..(196): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaangccacctctcctgcagggccagtcagagttgttacaacaactagcctgtancagcagacnctggcagcnccgngctctnatctatgtcactccacgagggccntgactcncccagcctaggttcaggtcggctagggtcggggtcgtggggaactaagtacgtttccacttactaccaaccgtattccgaaacggtaccaccggtcccgttacggccgtaacggttacgttaaggtaacgttagtttttacggtactttaagttttactttacgttcgttacagtacgtagttagtagtaagttaacggtacggtaccgttaccggttacgttacggtttacgggaccggtaacgggggaaccgtacgggtacggtacgggtaacggaacgtaacggtaaaacgaggttaacggtacggtcgtacgaccgtactacgttcgtacg

SEQ ID NO: 341393 - DNA, 548 bp, Homo sapiens
  misc_feature: GZ8MTXP02IJM6T.51.64.F09.1.454.CMB.2.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccacctctcctgcagggccagtcagagtgtttcaacacctagcctggtatcagcagaagcctggccaggcctcccaggctcctcatctatggttcatcccacgagggcccntgatactccagcctaggttcagtcgcaggtggtctgggacagtacttcatctacacatcagcagcctgcagtctagaatattttagcttagtttacttacttgttacagtcaagttatagtaattaaggtcggtcctacggtacttacgtttcggaccgtacgggggacctaggtcgttaggacgtaacgtacgaaaacgtaacgtggtacggtaccgtacgaccaccgatttacgtcg

SEQ ID NO: 341394 - DNA, 604 bp, Homo sapiens
  misc_feature: GZ8MTXP02F7J2T.51.64.F09.1.454.CMB.2.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaagagccaccctctcctgcagggccagtcagagtgttcaacactagcctggtatcagcagagcctggccaggctcccgaggcctcctnactctatggttcatcccacgagggccnctgatactcccagcccaggttccaggtcggctaggtgggtctaggggactaagtacttccgaactctccgaaccatccagcacgcctgcagtctagagttatttgacttagtttattactgtactagtactagtagtagtagtaacggtcggtaccgttaccgttaccgttaaccggttttccgggaccggtaacgggggtacccggtagggtccgttagggaacgtacgtaaccggaaaaccggtaaacgtaacgggtacggtaccgtacgaccgtaaccctacttacgttacg

SEQ ID NO: 341395 - DNA, 518 bp, Homo sapiens
  misc_feature: GZ8MTXP02FJXCD.51.64.F09.1.454.CMB.2.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttctaaacaacctagcctggtatcagcagagcctggccaggctcccaggctcctcatctatggttcatccacaggggccnctgatatcccagccaggttcagtcggcagtgggtctggacagattcactctcaccatcagcagctgcagtctgaagtatttgctagtttattactgtctagcagtatgataagtggctaccgtactacgtttcggccgtacggggacctagggacgtagggtaagacgtaacgaaacgtaaacgtgtggtactcgaccaccactcttcg

SEQ ID NO: 341396 - DNA, 580 bp, Homo sapiens
  misc_feature: GZ8MTXP02F3ZWR.51.64.F09.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagatgtttcaacacctagcctggtatcagcaganctggccaggctcccaggctcctcatctatgttcatccacngggccntgactatcccagccaggttcagtgctagtgggtctgggacagacttcacttcncaccatccancacgcctgcagtctagaagtatttcgcttagtttattacgtgtacagtctagtagtagtagttaaggtcgtaccgttaccgttaacgttaccgttttacgggacccggtaacgggggtacccgtagggtacggttagggaaacgtaacgttaaccgaaaacggtaaaccgttggtacgggtccgtacggaccctaaccgtaacctttcgtttaccg

SEQ ID NO: 341397 - DNA, 583 bp, Homo sapiens
  misc_feature: GZ8MTXP02IF2MB.51.64.F09.1.454.CMB.2.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggcctcccagacaccactggacaaatagtgatgacgcagtctccaggccaccctgtctgtgtctccgagggggaaanacgccaccctctcctgcagggccagtcagtagttgtttactaaacaacctagcctggtatcagcagaagcctggccaggcctccaggctccncatctatgtcatccacgnggccntgatactcccagcctaggttcaggtcggcaggtgggtctagggacaagtacttccactctaccaccctatcagcacgcctgctagtctagtaagttnttttgacttagtttattacgttgtacagtactagttagtagtaagtaggttcgtaccgttaccgtacttacgtttcggaccggtacggggtaccgagggtcgtaggaacgtacgtaaacgtaaacgtaacgttaaggtacggtcgtacggacctacctacttacgtttccg

SEQ ID NO: 341398 - DNA, 593 bp, Homo sapiens
  misc_feature: GZ8MTXP02GS38A.51.64.F09.1.454.CMB.2.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaanagccaccctctcctgcagggccagtcagagtgtttcaacacctagcctggtatcagcagaagcctggccaggctcccaggctcctcatctatggttcatccacaggccntgatctcccagccaggttcagtcgcagtggtctgggacagattcactctcacatcagcagcctgcagtctagaagtattttagcttagtttactttaccgttgtaccaggtacctagttagtagtaagttaacggttcggtaccttaccggttaacttaaccggtttttcgggacccggttaacgggggaccccgtagggtaccggttacgggaagtacgtaaccgtaaaaccgtaacgtcggttacgggtaccttacggaccgtaacccgtaacgtttactttaccgg

SEQ ID NO: 341399 - DNA, 542 bp, Homo sapiens
  misc_feature: GZ8MTXP02FQVW5.51.64.F09.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanagccaccctctcctgcagggccagtcagagtgtttacaacaacctgcctggtatcagcagagcctggccaggctcccgagctcctnatctatggttcatccaccgngggccntgatctcccagccaggttcaggtggctaggtgggtctggggacagtacttcacttctacaccatcancagctgcgtagtctagaattatttgacttagtttattacgtgtacgtagtacgtagtatagtaagtaggtcgtccgttacgtacttacgtttcggacggtacgggaccgaggtcgtaggacgtacgtaacgaacgtagtaaggtcgacgtcgacactctacgttcg

SEQ ID NO: 341400 - DNA, 726 bp, Homo sapiens
  misc_feature: GZ8MTXP02G0SZS.51.64.F09.1.454.CMB.2.raw
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccacctctctcgcgacgcgcngacagtgttcttacaactacgtctcgtagtncgagagagactcgtcgacgacgccaccggacgtcctctcacttactggttcgtactacgtacccgacggccggcctcgtagtaactaccgtacccgacgtaccggtacggttacgacggggtcggacgtacggggtcggttcgggacgaacgtagttactctccttaccaccgacactacgacacgtaccgtcacgacgtcgttacggtaagttaaacgttttgtttaacgtacgttttagtttttaaactcgttacgtacgggtaacttagttaaggttaataaggttaagttaccggttacccgttcccgtttaaccgttaaacggtttttcgggttacccgggaaccgggggtaaaaccgggttccggacgggtaaccgggtaagggtaaacttaaaccggtaaaccggtaaaacggttaacgggttcggccggtttacggaacccgtaccgtttaacctcggttttaacccg

SEQ ID NO: 341401 - DNA, 570 bp, Homo sapiens
  misc_feature: GZ8MTXP02H6EO4.51.64.F09.1.454.CMB.2.raw
  modified_base (307)..(307): a, c, t, g, unknown or other
  misc_feature (307)..(307): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctcgaagggaagagccaccctctcctgcagggccagtcagagtgtttactaacactagctggtatcagcagagcctggccaggcctccgaggcctctcatctatcggttcatccacgagggccnctgatactccagcctaggtcagtcggcaggtggctgggacagtactcactctacaccatcagcacgctgcagtcgtagagtatttgacttagtttaatacttcgtactagtactagtatacgtagtaacggtcggtacctacgttaccttacgtttacggaccggtacgggggaaccgtagggtacgttagggaacgtaacgtaaccgtaaacggtaacgttaacggtacggtacgttacgaccgtaccgtactttacgttcg

SEQ ID NO: 341402 - DNA, 558 bp, Homo sapiens
  misc_feature: GZ8MTXP02GKLKB.51.64.F09.1.454.CMB.2.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (427)..(427): a, c, t, g, unknown or other
  misc_feature (427)..(427): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtcctccgaaggggaancgccaccctctccngcagggccagtcagagttgtttacaaacacctagcctggtatcagcagagcctggccaggctccagctcnatctangttcactccaccgagggccntgatactcccagcctaggtcaggtcgcaggtggtctggggacaggattcgactctcacctatcagcagcctgcagtctagtaacgttatttgtacgttagtttacttacttgtacagtntagtatagtaagtaagtcggtaccttacgttacgttacgtttcgggaccgtacggggaccgtaggcgttaggagtaacgtaaccgaaaacgtacgtaaggtacggactacggacctacctacgttcttacg

SEQ ID NO: 341403 - DNA, 562 bp, Homo sapiens
  misc_feature: GZ8MTXP02JF8MT.51.64.F09.1.454.CMB.2.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaanagcccacctctcctgcagggccagtcagngtgttctaacacctagcctggtatcagcagacgcctgccaggctccgaggctccncatctatggtcactccacaggccntgactactcccagccaggttcagtccggctaggtcggtctgggacaggtacttcacttccgtcaccatccagcacgctgcagttctagtacgtattttgacttagtttattacgtgtacgtagtcgtaagttagtagtagttaacgtcggtaccttcgtacttacgtttcggaccggtacggggtaccagggtacgtaggaacgacgtaacgaaacgtaacgtggtacggtctacggacctacctacgttcgttacg

SEQ ID NO: 341404 - DNA, 598 bp, Homo sapiens
  misc_feature: GZ8MTXP02JRA9U.51.64.F09.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttcaacaacctagcctggtatcagcagaagcctggccaggctccagctccnatctatggtcatccacaggccntgatactcccagcctaggttcagtcggcaggtggtctgggacagattcactctcaccatcacgcacgcctagctagtcgtagtaatattttagcttaagtttattacgtgttacgagtactagtagtagtaagttaaacggtcggtacccgttaccggttaaccgttacgttttacggggacccggttaacgggggaccccgtagggtccgttaggggaacgttaacgaaccgtaaaaacgggtaacgtaacggtacgggtaccgttacggacctacccggtaacttccgtttacg

SEQ ID NO: 341405 - DNA, 547 bp, Homo sapiens
  misc_feature: GZ8MTXP02GBNU5.51.64.F09.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttctaaacacctagcctggtatcagcagagcctggccaggctcccaggctccncatctatgttcactcccacgcgggccntgactactcccagtcccgaggttcaggtcggctaggtgggtctaggggacaggtattcactctcaccatcancacgcctgctagtctagtagtatttgactagtttattactgttcgagtctagtagtagtaataaggtcggtacctaccggttactacgtttggaccgtaacggggaccagggcgtaggaacgtactaaccgaaacgtaacgtcgtagacgtcgacaccagttcttacg

SEQ ID NO: 341406 - DNA, 584 bp, Homo sapiens
  misc_feature: GZ8MTXP02HB33X.51.64.F09.1.454.CMB.2.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaancgccacctctcctgcagggccagtcagagttgttcaacacctgcctggtatcagcagaacgcctggccaggcctcccgaggtcctcctcatctatcggtcactccacgngggccntgactactcccagccgtaggtcaggtcgctaggtggtctgggacagtacttcacgtcacacctatcgagcacgtcctgacgtagtcgtagtacgttactttcggacttagtttacttacgtagttacagtactagttagtagtagttaacggtcgtaccgttacgtacgttacgtttcggaccggtacgggtacccgtaggtccgtagggtaacgtacgtaaccgaaacgttacgtggtacggtactacggacctaccgtacgttcgttaccg

SEQ ID NO: 341407 - DNA, 587 bp, Homo sapiens
  misc_feature: GZ8MTXP02GWFJ5.51.64.F09.1.454.CMB.2.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagtagttgtttacaaacacctagcccttggtaatcagcaagagcctggccaggctcccagcctccncatctatgttcactccacgaggccntgatactcccagccgtaggtcagtcggctaggtgggtctggggacaagtacgttccacgttcctacaacctatccagaccagccctgcgtacgtcgtagtaagtttattttacgacttagttttattacgttcgtactagtactagttatacgtaagtaagtcggtacccttacgtacttacggtttcggacgtacggggaccagggtcgtaggtacgaacgttaccgaaaacgtacgtaaggtcggtacgacgacctaacctcgttactttcg

SEQ ID NO: 341408 - DNA, 577 bp, Homo sapiens
  misc_feature: GZ8MTXP02IMM0I.51.64.F09.1.454.CMB.2.raw
  modified_base (195)..(195): a, c, t, g, unknown or other
  misc_feature (195)..(195): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatgtgatgacgcagtctccaggcaccctgtctgtgtctccaggggaaangccaccctctcctgcagggccagtcagagtgtttacaacaacctagcctggatcagcagaagcctggccaggctcccaggctcctcatctatggttcatcccacaggccnctgatacncccagcctaggttcaggtcgactaggtgggtctggggaaccagtattcaactcctcaaccatcagcagcctgcagtctagtaagttagtttagacttagtttattactgtcagtacagtatagtagtaagtcgtaccgttccgtacttacgtttcgggacccgtacggggtacccgtagggaccttaggggaacgtaacgtaaccgtaaaacggtaaccgtaaggtacggtaccgttacggaccctaccgtaatttccgtttcg

SEQ ID NO: 341409 - DNA, 501 bp, Homo sapiens
  misc_feature: GZ8MTXP02HNEHB.51.64.F09.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (359)..(359): a, c, t, g, unknown or other
  misc_feature (359)..(359): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagccaccctctcctgcagggccagtcagagtgtttctaaacacctagcctggtatcagcagaagcctggccaggctcccaggctcctcatctatggttcatccaccaggccnctgatacnccagccaggttcagtcggcagtggtctgggacagattcactcncaccatcagcagcctgcagtctgaagtatttgctagtttattatgtcagtcagtatgtataagtgcctcgtactacgtttggctacggggtaccagggctaggacgagtacaaacgaacgtgtcgcgtcgacacacttctcg

SEQ ID NO: 341410 - DNA, 554 bp, Homo sapiens
  misc_feature: GZ8MTXP02F2QN6.51.64.F09.1.454.CMB.2.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttcaacactagcctggtatcagcaganctggccagctccagctcctnatctatgtcatccacgnggccntgatactcccagccaggttcagtcgcaggtggtctggacagtattcacttcaccaccatcagcagcctgacagtcagtagttagtttgtacttagtttaacttacgttgtacgtacgtactagtatagtaagtaacggtcgtaccgttacgttacttacgtttacggaccggtaacggggtaccgaggtcgtagggacgtacgtaacgaaacggtacgtggtacggtactacggacctaccgtacttacgtttccg

SEQ ID NO: 341411 - DNA, 526 bp, Homo sapiens
  misc_feature: GZ8MTXP02IAI8B.51.64.F09.1.454.CMB.2.raw
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctcgagggaagagccaccctctcctgcagggccagtcagagtgtttcaacacctagcctggtatcagcagagctggccaggctccagctccnatctatgttcntccacngggccnctgatntcccagccaggttcagtcggcaggtggcgtggacagtatcactctacaccatcancctancctgcacgtctaggaattctttgacttagtttatactgtacagtatagtatagtacgttaagtcggtacctaccggttactacgtttcggaccgtagggacctgggacttgggaactacgtaacgaacgtaactgggtcgactcgaccacgtactacgttcg

SEQ ID NO: 341412 - DNA, 563 bp, Homo sapiens
  misc_feature: GZ8MTXP02HN9C9.51.64.F09.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagtgttcaacaactagcctggtatcagcagagcctggccaggctcccaggctcctcatctatggtcatccacgaggccnctgatactccagcctaggttcaggtcggcaggtcgggtctaggggacaaggatttcgaactctaccaccatcagctacgcctgcagtcgtagtaagtntttgcttagtttattacttgtcagtctagtatagattagtcgtaccgtacgtacgttacgtttcgaccggtacggggaccgagggtccgtaggtacgtaacgttaccgaaaacggtaccggttaagtacgggtacttacggcctaaaccgtcttacgtttccg

SEQ ID NO: 341413 - DNA, 536 bp, Homo sapiens
  misc_feature: GZ8MTXP02F4T6A.51.64.F09.1.454.CMB.2.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaagagccaccctctcctgcagggccagtcagagtgtttcaacacctagcctggtatcagcagagctggccaggctccagctcctnatctatgtcatccacgaggccntgatatccgagccaggttcagtcggcagtgggtctgggacagtattcacttcacaccatccagcagcctgaccagtctagtaagtattttgactacgtttattacgttgtacgtagtctagtatagaataaggttcgtacccgttaccgtacgttaacgttttcggaccggtacggggaccgtagggcgtaggacgactaccgaaacgtacgtggtaggcgtagctagtcattcg

SEQ ID NO: 341414 - DNA, 603 bp, Homo sapiens
  misc_feature: GZ8MTXP02JWJ95.51.64.F09.1.454.CMB.2.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgcccaccctctcctgcagggccagtcagagttgttactaaacacctagcctggtatcagcagacgcctggccaggcctccgaggcctccncatctagtgttcactccacgaggccntgactactcccgagtccgtaggttccaggttcggcgtagggtcgggtacgtaggggactaggtacttccgaacttcctaccacctatccgagcacgtcctgcgacgtcgtagtaacgttagtttgacgttagtttacttacgttgtactagtctagttagtagtagtacggtcgtaccgtacgttacgttacgtttcggaccggtacgggaccgaggtacgtaggacgtacgtaaccgtaaacggtacgtcggtacggtacgtacgtacctaccgtacttccgtttacg

SEQ ID NO: 341415 - DNA, 529 bp, Homo sapiens
  misc_feature: GZ8MTXP02JBRBZ.51.64.F09.1.454.CMB.2.raw
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
  modified_base (347)..(347): a, c, t, g, unknown or other
  misc_feature (347)..(347): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcacctgtctgtgtctccaggggaagccacctctcctgcagggccagtcagagtgttcaacacctgcctggtatcagcagagcctggccaggctccagctcncatctatgtcatccacaggccntgactatcccagcctaggtcagtgcagtggtctgggacagatcacttctacaccntcagcagcctgcgagtctcgtaagtatttgactagtttatactgtcagtctagtagtacgtatagtcgtcctacgttactacgtttcggaccgtacggggacctacgggtcgtacgggtagtacgttaaccgaacggtaaacgtcggtacggtacgtacggacctacctacgttacgtttcg

SEQ ID NO: 341416 - DNA, 513 bp, Homo sapiens
  misc_feature: GZ8MTXP02IS5EL.51.64.F09.1.454.CMB.2.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
  modified_base (409)..(409): a, c, t, g, unknown or other
  misc_feature (409)..(409): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctntcctgcagggccagtcagagttgtttcaacacctagcctggtatcagcagagcctggcaggctccagctccnatctatggttcatccacgaggccntgatatcccagcctaggttcaggtcgcaggtggtctgggacagacttcactcnctaccatcagcagcctgcagtctagaagtagtttgactagtttattatgttcagtntagtatagatagtgacctcgtactacgtttgaccgacgggtaccgaggcttacggagacgttacgaaacgtacgtggtacgcgtacgacacctacgtctttacg

SEQ ID NO: 341417 - DNA, 649 bp, Homo sapiens
  misc_feature: GZ8MTXP02FYDCE.51.64.F09.1.454.CMB.2.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (348)..(348): a, c, t, g, unknown or other
  misc_feature (348)..(348): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggcctcccagacaccactggacaaatagtgatgacgcagtctccaggccaccctgtctgtgtctaccgaagggggaaancgcccaccctctcctgcacgggccagtcagtagttgtttacaaacaacctgcctggtatcagcaagacgcgtggccaggcctcccgaggtcctcctanacttctattggttccactcccacggacggggtcccagtagtaactacncccgagtccgtaggttcgaggtcggggactagggtcgggtacgtagggaacctagtacttccacttaccgtaccaacctatcgacgcgacggtcctacgacgtacgttacgtaggtaagtttacttttacgtacgttaacgtttacttacgttacgtatacgtacgtagttaagtagtaagttaagtcggtaccttaccgtacgttacgtttacgacggtacgggacgacggtacgtacggaatacgtaaaccgaaacgtacggtaacgaggtacgtacgaccgtaccgtactcggtttac

SEQ ID NO: 341418 - DNA, 517 bp, Homo sapiens
  misc_feature: GZ8MTXP02I1F34.51.64.F09.1.454.CMB.2.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatgtgatgacgcagtctccaggcaccctgtctgtgtctccaggggaancgccacctctcctgcagggccagtcagagtgttcaacacctgcctggtatcagcagagctgccaggctccaggctctcatctatgtcatccacaggccntgatntcccagccagtcagtcgcagtggtctgggacagattcactctcacatcacncgagcctgcagtctgaacgttntttaggactagtttattactgtcagtctagtatgatagtcgaccttcgtactacgtttggccgtaacggggtaccaggtccgtagggaacgtacgttaaccgaaacgtacgtaaggtcgacgttcgacctaccgtactcgtttacg

SEQ ID NO: 341419 - DNA, 563 bp, Homo sapiens
  misc_feature: GZ8MTXP02JFHIQ.51.64.F09.1.454.CMB.2.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgttactaacaacctagcctggtatcagcagaagcctggccaggcctcccgaggctcctcatctatggttcatccacgagggccntgatctcccagccaggttcaggtcggctaggtcggtcgtaggggacaggtacttccacttctccaacctatcagcagccctgcagtctagtaagtgttttgacttagtttattacgtgtcagcgtagtagtagaattacggtacgtaccttcgtactacgtttcggaccgtacggggtaccagggtcgtagggacgtacgtaaccgtaaacgtaacgtggtacggtacgtcgtaccgactacgttcgttacg

SEQ ID NO: 341420 - DNA, 629 bp, Homo sapiens
  misc_feature: GZ8MTXP02GYKA0.51.64.F09.1.454.CMB.2.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagttgtttacaacaacctgcctggtatcagcagagcctggcccaggcctacccgaggcctcctcatctagtgttccactccacgagggccntagacttactcccaggtccctaggttcaggttcggacgtagggttggggtctaggggaactaggtatttcccacttcctaccacctatcagcacgtccgtaggacctagttccgtaggtaaagttagttttacgacgtttagtttacttacgttggtactagtacgtaagttagtagtaacgtaacggtcgtacccgttacgttacgttacgtttacggaccggtacggggtaccgtaggtaccgttagggacgtaacgtaacgtaaacggtaacgtcggtacggtactacgaccgtacgtacgttactttcg

SEQ ID NO: 341421 - DNA, 574 bp, Homo sapiens
  misc_feature: GZ8MTXP02FL56W.51.64.F09.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaanagccaccctctcctgcagggccagtcagagtgtttacaacaacctagcctggtatcagcagagcctggccaggctcccaggctcctnatctatggttcactccaccgagggccgctgactactcccagccaggttcaggtcggcaggtgggtctggggacagtacttcactctccacatcagctagcctgcgagtactagaagtagttttagcttagtttattaacgttgtactagtactagttatagtaagttaaggtcggtaccttaccgttactacgttttcggaccggtacggggtaccgacggtcgtacggacgtacgtaaccgtaaacgtaacgtcggtacggtacgtcgaccgtaccacgtttacgttccg

SEQ ID NO: 341422 - DNA, 529 bp, Homo sapiens
  misc_feature: GZ8MTXP02FGZD1.51.64.F09.1.454.CMB.2.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctctcctgcagggccagtcagagtgtttctaacacctagcctggtatcagcagagcctggccaggctcccaggctcctcatctatggttcactccaccagggccnctgatanccccagccaggtttcagtcggctaggtgggtctggggacagtactcactctcaccatcagcagccctgcagtctagaagtatttgctagtttattactgtcagctagtatgtaactaagtcgaccgttccgtactacgttttcggaccgtacggggtaccaggtcgtagggacgacgtaacaaacgaacgtggtggacgtcgacacctatcttacg

SEQ ID NO: 341423 - DNA, 563 bp, Homo sapiens
  misc_feature: GZ8MTXP02HLNI4.51.64.F09.1.454.CMB.2.raw
  modified_base (196)..(196): a, c, t, g, unknown or other
  misc_feature (196)..(196): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctctcctgcagggccagtcagagttgtttacaacaacctagccttaggtatcagcagancctgccaggctccaggctcctnatctatggttcatccacgagggccnctgactactccagccgtaggttccaggtcggcaggtcgggtactgggacaggacttcactctacacctatcanctagccctgctagtctagtaagtatttgacttagtttactttactgtcaggtatagtagtagtacttaaggtcgtcccgttacgtacttacgttttcggaccggtacggggaccctagggaccgtaggtaacggaactacgaaaacggacgtaaggtcgacgacgaccaacctattacttcg

SEQ ID NO: 341424 - DNA, 560 bp, Homo sapiens
  misc_feature: GZ8MTXP02FJI0P.51.64.F09.1.454.CMB.2.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaagngccaccctctcctgcaggccagtcagagtgtttcaacacctagcctggtatcagcagaagcctggccaggctcccaggcctctcatctatgttcatccacgnggccntgatctccgagccaggttcagtcggctaggtgggtctggggacaggattcactctacaccatccagcacgcctgcagtctacgaagttatttgcttagtttatacttgtacagtacgtagtatagtacgttaagtcggtacccgttaccgttacgtacgttttcggaccgtaggggtaccgaggtcgtaggtaacgtacgtaacgaaacggtaacgtaacggtcggtacgtacggaccctactacgttctttccg

SEQ ID NO: 341425 - DNA, 560 bp, Homo sapiens
  misc_feature: GZ8MTXP02JEYX6.51.64.F09.1.454.CMB.2.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaanagcccaccctctcctgcagggccagtcagagtgttctaacacctgcctggtancagcaganctgcaggctccagctctnatctatcgttacnctccaccgagggccntgatactcccagcctaggttcaggtcggcgtaggtgggtcgtgggacagtacttcaactctcactatacagcacgtccctgcgtacgtcgttagaacgtttagtttacggatttagttttattacgtgttacgtagtacgtagttagtagtaagttaaaggtcggtacccgttcgtaacttcggtttcggaccggtacggggaccaggcgtaggacgtactacgaaacgagtggacgtccngtaccncctntactcg

SEQ ID NO: 341426 - DNA, 617 bp, Homo sapiens
  misc_feature: GZ8MTXP02FUJGJ.51.64.F09.1.454.CMB.2.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaaggggaaancgcccaccctctcctgcagggccagtcagagtgtttcaaacacctagcctggtatcagcagaacgcctggccaggcctcccgaggcctcctnatctatgtcatcccgacgagggccntgactactcccgagcccaggttcaggttcggctaggtgggtactagggacaagtatccaactctaccaccatcgacgacacgccctgacgtacgtacgttagtaaacgttagttttcgtacgtttaaagttttaacgtttaaacgtttggttacctagacgtagttaagtagttaacgttaaggtcgttacccgttaccgttacttacgttttacggaccggtaacggggaccgaggtcgtaggaacgtactaaacgaaacgtaacgtaacggtcgtacgtacgactaccgattcgtttacg

SEQ ID NO: 341427 - DNA, 536 bp, Homo sapiens
  misc_feature: GZ8MTXP02F5BF5.51.64.F09.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctcaggggaaangccaccctncctgcagggccagtcagagttntttacaaacacctagcctggtatcagcagaagcctggccaggcctccaggctctnatctatgtcatccacagggccnctgatactcccagccaggttcaggtcggacaggtcgggtctgggacagtattcacttcncaccatcgagcgancccgtagcgtagtcgttagaagttatttagactagtttacttacgtgtcagcagtatgagtagtcgtacctccgtactacgtttggccgtacggggacaggacgtaggacgtacgtacgaaaccgtaagtgtcggtactacggacaccgtatacgtttcg

SEQ ID NO: 341428 - DNA, 682 bp, Homo sapiens
  misc_feature: GZ8MTXP02FWL4I.51.64.F09.1.454.CMB.2.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagttgttacaacacctagcatggtancgagcagancgttaaccgggtaccgtacggtaccgtacccgtacggtaccttaccgtacgtacgttacgtacgtcggttactacgtaccgtacgtacggtaccgtcgtacgtacgtacgtaccgtacgtaccgtacgtacgacggtacgtacgtaggtcgtacgtacggtacgtacgtacttaccgacgttaccgtaccgtacgtacgtaccgtacgtacgtaccggttcgtacggtacgtacgttacgtacggtaacgttacgttacgactttacgttacgtacgtcgtacgtacgtacgtacggtacgtacgtacgtacggtcgtaccgtcgttaacgtcgttacggtacggtacggtaccgtcggtacgtacggtacgtacgtacgtacgtaacgtcgtacggtacttaccgacgtacgtacgttacg

SEQ ID NO: 341429 - DNA, 642 bp, Homo sapiens
  misc_feature: GZ8MTXP02IQE7G.51.64.F09.1.454.CMB.2.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctccngcagggccagtcagagttntttaccaacacctagcctggtancagcagagccngccaggctccgagctcncatctatgtcatccacgaggccntgactacgtcccagcctaggttcaggttcggactaggtcgggtctaggggactagacttccgaactccgtaccaaccatccgaaagccgaacgtcccgtagaccgtacggttaccgtaacggtaaagtttacgttttacggtactttacggtttaactttacgttacgttacgtagtacgtaagttacgtaagtaagttaacggttcgtaccgttaccgttacgttacgtttacggacccggtacggggtaacccgtgggtaccgtagggtaacgtaacgtaaccgtaaaacggtacgtaacggtacggtacgtacggacctaacctacgttactttcg

SEQ ID NO: 341430 - DNA, 685 bp, Homo sapiens
  misc_feature: GZ8MTXP02GKGJ5.51.64.F09.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaangccaccctctcctgcagggccagtcagagtgtttcaacacctagcctggtatcagcagagcctggccaggcctcccgagctccnatctatgtcactcccacgagggccntgactactcccagcctaggttcaggtcggcagggttcgggtactggggactagtactttccacttcctaccaccctaatccgacgaccgacgtacccgtacgacctaacggttaccgttaaggtaaacgtttaagtttttacgtaccgtttaaaggtttttaactttaaaccgtttcggttacgtaacggtaaccgttaaggttaacgttaagtaaagtttaaacgggttcggttaccccgtttaaccgtttaaccgttacgtttttacgggacccggtaacgggggttacccgagggtaccggtagggtaacgtaacgttaaccggaaaacgtacgttaacggtacggtacgtacggacctaccggtactcgtttacg

SEQ ID NO: 341431 - DNA, 599 bp, Homo sapiens
  misc_feature: GZ8MTXP02GJYE2.51.64.F09.1.454.CMB.2.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (433)..(433): a, c, t, g, unknown or other
  misc_feature (433)..(433): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccgaggggaaancgccaccctctcctgcagggccagtcagagtgtttacaacacctagcctggtatcagcagagctggccagctccagctcctnatctatgtcactccacgaggccntgatactcccagccgtaggttcagtcggctaggtggtctgggacagtacttcactcacaccatcgatcgacgtctcgactacgttgtagaactttgtttacgactttaagtttattacgtcgtacgtagtntagttagtacgtaagttacggtcgttaccgttacgttacgtttacggtttacggaacccgggtacgggtacccgtagggttaccgtaagggaccgttaacgtaacccgtaaacggtacggtaacggtacgggtcttaccggaacctacggtaacttccggtttccg

SEQ ID NO: 341432 - DNA, 559 bp, Homo sapiens
  misc_feature: GZ8MTXP02FZFXA.51.64.F09.1.454.CMB.2.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (549)..(549): a, c, t, g, unknown or other
  misc_feature (549)..(549): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggaacaaatagtgatgacgcagtctccaggcaccctgtctgtgtctccgaggggaaancgccaccctntcctgcagggccagtcagtagttgtttaccaaacacctagcctggtatcagcagagcctggccaggcctcccaggcctcncatctatgtcatcccacgcggccntnactcncccgagcctaggtcaggtcggctaggtggtcgtaggaacagtactccacttctaccacngtacncgcagccctgactagtctagagtttagtttgtcttaagtttcttagtgtcgagtacgtagtagtagaacgtaggtcgaccgtttacgtagttacggttcgacggtacggggacctagggactaggaactacgtaaccgaaagtacgtgtacgctacgcctaacgtnttaccgttcg

SEQ ID NO: 341433 - DNA, 697 bp, Homo sapiens
  misc_feature: GZ8MTXP02F6A6N.51.64.F09.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctccagacaccatggacaaatgtgatgacgcagtctccaggcaccctgtctgtgtctccgaaggggaaancgccaccctntcctggcagggccagtcagnttgtttcaaacacctgcctggtancagcagacncctggcaggcctcccgagcctacctnatctagttcggtcaactcccacggacgggccctntagaactcgcccgagccgaagggtttcaaggttggaccgtaggttcggggtaccgtaggggaaacctaaggtactttcccaacgttacctaccaacccgtaaatcccgaaggacctaacggcccttacggtaccaaggttacccttaacggtaaacggttaacttttacggtaacgttaaaacgttttaattttaaaccgttcggttaaacgtaacgtaacgtaacgttaagtaacgtaaacgttaacggttaccggtaccgttaccggttacgttacggtttacggaccgggtaacgggtacgtacggtacggtaaggtaaacgtaacgtaaacgaacgtaacgtcggtacgacgtacgaccgtactacgttcgtacg

SEQ ID NO: 341434 - DNA, 565 bp, Homo sapiens
  misc_feature: GZ8MTXP02F3MZZ.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagtagtgttcaacactgcctggatcagcaganctggccaggctccagctcctnatcagtcgtcatccacgnggccntgatctcccgagccgtagttcagtccggcaggtggtctagggacagtattccgactctcactatcgagtcacgtccctgactaggttctagagttatttgacttagtttatacgtgtacagctagtatagtagtaacgtcggtccttacgtacttacgtttcgggaccgtaacggggtaccgacgggtacgtagggaacgtaacgtaaacgaaaccggtaacgttcgggtacggtaccgttacggacctaccgtacgttcggtttacg

SEQ ID NO: 341435 - DNA, 550 bp, Homo sapiens
  misc_feature: GZ8MTXP02I4GIZ.51.64.F09.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccaccctntcctgcagggccagtcagatgtttcaanacctgcctggtatcagcagagcctggccaggctccaggctcnatcatgtcntccacagggccntgatacncccanccaggttcagtcggcagttcgggtctgggacagtattcaactctcaccntcgancagcctgcaagtctgaagtattttgactagtttattactagtcagctagtatagtaataaggtcgtccgttacgtacgttacgttttacgggaccgttacggggccgtaaagggtccgttaaggaacggtacgttaaccggaaaccgtaaacgtcgtaaggtcctacgaccgaacctaggtactttcg

SEQ ID NO: 341436 - DNA, 551 bp, Homo sapiens
  misc_feature: GZ8MTXP02IUAEU.51.64.F09.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagcgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaangccacctctcctgcagggccagtcagagtgtttacaacactagcctggtatcagcagaagcctggccaggctcccaggctcctnatctatgttcactccacaggccnctgatactccagccaggttcagtcggcagtgggtctggacagattcactctcaccatcagactagcctgacagttcgtagtaagttatttagtcttagtttattactgttcacgtntagtatagtagtaagtcgtcctcgttacgtacgtttcggacgtacgggaccgtggtacgtaggaacgtacgttaaaccgaaacgtacgttaaggtcggtacgttacggtaccgaaccgtactttcgtttacg

SEQ ID NO: 341437 - DNA, 499 bp, Homo sapiens
  misc_feature: GZ8MTXP01AVRM6.8.67.G01.1.454.CMB.2.raw
  modified_base (230)..(230): a, c, t, g, unknown or other
  misc_feature (230)..(230): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaacncccccaaatcctgatttatggtgcatccatttcgcaaagtgggtcccatcaaggttcagtggcagtggatctgggggcagatttcaccctcaccatcagcagtctgcaacctgaaagactttgcaaacttactactgtcagcagtcttacagtaggccggcaccgtttggccaggggacgaagctaggagagtcgaaacggaactggtggctgcaccatctgtcttcaatccttcccgcatctgacgcacgcagcngnggcggcgngng

SEQ ID NO: 341438 - DNA, 498 bp, Homo sapiens
  misc_feature: GZ8MTXP01DNOY2.8.67.G01.1.454.CMB.2.raw
  modified_base (319)..(319): a, c, t, g, unknown or other
  misc_feature (319)..(319): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaagcccccaaactcctgatttatggtgcatccatttcgcaaagtggggcccatcaaggttcagtggcagtggatctggggcagatttcaccctnacccatcagcagtctgccaacctgaagactttgacaacttctactgtcagcagtcttacagtaggccgggcacctttggccaggggacgaagctggagatcgaacgaacgtgtggctgcaccatctgtcttcatcttccgcattctgagacacgcgngctgagcgggctggcaaggcgn

SEQ ID NO: 341439 - DNA, 500 bp, Homo sapiens
  misc_feature: GZ8MTXP01E3CFF.8.67.G01.1.454.CMB.2.raw
  modified_base (487)..(487): a, c, t, g, unknown or other
  misc_feature (487)..(487): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaatcctgatttatggtgcatccatttcgcaaagtgggcccatcaaggttcagtggcagtggatctggggcagatttcaccctcaccatcagcagtctgccaacctgaagtactttgacaacttctactgtcagcagtcttacagtaggccggcaccgttggccaggggacgaagcgtggagatcgaacgaacgtgtggctgcaccatctgtcttcatcttcccgcattctgagacacgcgagctgagcggcgnggcgaacggcgcg

SEQ ID NO: 341440 - DNA, 515 bp, Homo sapiens
  misc_feature: GZ8MTXP01C7MIJ.8.67.G01.1.454.CMB.2.raw
  modified_base (457)..(457): a, c, t, g, unknown or other
  misc_feature (457)..(457): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttatggtgcatccatttcgcaaagtgggtcccatcaaggttcagtggcagtggatctgggggcagatttccaccctcaccatcagcagtctgcaacctgaaagtactttgactaaacttactactgtcagcagtctacagtaggccggcaccgtttgggccagggggacgaagcgtaggagagtacgaacgaactggtggctgcacntctgtcttcaatccttcccgccatctgacgcacgcgagctggagcgggcgttggaacg

SEQ ID NO: 341441 - DNA, 498 bp, Homo sapiens
  misc_feature: GZ8MTXP01CT9NL.8.67.G01.1.454.CMB.2.raw
  modified_base (254)..(254): a, c, t, g, unknown or other
  misc_feature (254)..(254): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaaatcctgatttanggtgcatccatttcgcaaagtgggtcccatcaaggttcagtggcagtggatcgtggggcagntttcaccctnaccatcagcacgtctgcaacctgaaaagactttgctaaacttactactgtcagcagtctacagtagccggcactttggcaggggacaagctggagagtcgaacgaactgtggctgcaccgatctgtcttcaatcttcccgcatctnagcacgcgagctagngcggcgttgcg

SEQ ID NO: 341442 - DNA, 516 bp, Homo sapiens
  misc_feature: GZ8MTXP01D0SO9.8.67.G01.1.454.CMB.2.raw
  modified_base (234)..(234): a, c, t, g, unknown or other
  misc_feature (234)..(234): n is a, c, g, or t
  modified_base (465)..(465): a, c, t, g, unknown or other
  misc_feature (465)..(465): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttatggtgcatccatttcgcaaagtgggtcccatcaagttcagtggcagtgatcgtgggcagatttcaccctcaccatcagcagtctgcaacctgaaaacgtactttgactaaacttactactgtacagcagtcttacagtacggccggctaccgttggccgaggggacaagctaggagagtacgaaacgtaactggtgctgcaccatctgtcttnaactcttcccgccttatctgacgcacgcgagctgacggcggcgttggaacg

SEQ ID NO: 341443 - DNA, 560 bp, Homo sapiens
  misc_feature: GZ8MTXP01BMOP0.8.67.G01.1.454.CMB.2.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagagcccaaggaaaacgccccccaaatcctgatttanggtncatccatttcgacaaagtgggcccatcaaggttcagtggcagtggatcgtgggcagtactttccaccctcaaccatcagcagtctgaccaacctgaagtactttgaacctaaacttcactgtacagctagtacttacaggtacggccggactaccgttggaccgtagggggacgaagcgtaggaagtatacgaacgaagtggtcggactcgacaacctntctcgtctctactcctcccnctacttcgtacgacgaccgacgcgcgcgtaacggcgggccgggtcggtcggacgtaacggcgaag

SEQ ID NO: 341444 - DNA, 505 bp, Homo sapiens
  misc_feature: GZ8MTXP01DVGLZ.8.67.G01.1.454.CMB.2.raw
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatgtatcaacagagcccaaggaaaacgcccccaaatcctgatttatggtgcatccatttcgcaaagtgggtcccatcaaggttcagtggcagtgatcgtggggcagtatttcaccctcaccatcagcagtctgcaacctgaaaagctttgactaaacttactactgtcagcagtcttanagtagccggctacgtttggaccgaggggacaagcgtaggagagtcgaaacgaactggtaggctgcaccatctntctcaatcttccgcatctgacgcacgcgagcgtgagcggcgngaacg

SEQ ID NO: 341445 - DNA, 512 bp, Homo sapiens
  misc_feature: GZ8MTXP01A1JWY.8.67.G01.1.454.CMB.2.raw
  modified_base (389)..(389): a, c, t, g, unknown or other
  misc_feature (389)..(389): n is a, c, g, or t
  modified_base (498)..(498): a, c, t, g, unknown or other
  misc_feature (498)..(498): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttatggtgcatccatttcgcaaagtgggtcccatcaaggttcagtggcagtggatcgtggggcagatttcaccctcaccatcagcacgtctgcaacctgaaaagtctttgactaaactttactactgtcagcagtctacngtacggccgggctaccgtttggccaggggacgaagcgtaggagagtcgaacgaactgtggctgcacatctgtcttcaatccttcccgccatctgagcacgcgagctggnggcgggcgttggcg

SEQ ID NO: 341446 - DNA, 509 bp, Homo sapiens
  misc_feature: GZ8MTXP01BIWUX.8.67.G01.1.454.CMB.2.raw
  modified_base (323)..(323): a, c, t, g, unknown or other
  misc_feature (323)..(323): n is a, c, g, or t
  modified_base (462)..(462): a, c, t, g, unknown or other
  misc_feature (462)..(462): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaatcctgatttatggtgcatccatttcgcaaagtgggtcccatcaaggttcagtggcagtggatcgtggggcagatttcaccctnaccatcagcagtctgcaacctgaaagactttgactaaactttacactgtcagcagtcttacagtacggccggctaccgttggccaggggacaagctaggacgagtcgaacgaactggtggctgacaccatcctgtcttnaacttcttcccgccatcctagacgcacgcgagtcgngngcgcgcgng

SEQ ID NO: 341447 - DNA, 526 bp, Homo sapiens
  misc_feature: GZ8MTXP01AXZSH.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctcctgtctgcttctataggagacagagtcaccatcacttgccgggcaagtcagaccattagctacctttttaaatggtatcaacagagcccaaggaaaacnccccaaactcctgatttanggtgcatccatttcgcaaagtgggtccatcaaggttcagtgcagtgatcgtggggcagatttcaccctnaccatcagcagtctgacaactgaaatctttgactaaacttactactgtcagcagtcttanagtacggccggctaccgtttggacccgagggggaccgaagcgtagggaggacgtacggaaacgtaacgtcgtaggcctgacaccgatctgtcttcaatccttcccgcatctgacgcacgcgagcgtggacggcggcgttggaacg

SEQ ID NO: 341448 - DNA, 532 bp, Homo sapiens
  misc_feature: GZ8MTXP01B59N7.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (502)..(502): a, c, t, g, unknown or other
  misc_feature (502)..(502): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctcctgtctgcttctataggagacagagtcaccatcacttggccgggcaagtcagaccattagctactttttaaatggtatcaacagagcccaaggaaaacncccccaaatcctgatttanggtgcatccatttcgacaaagtgggtcccatcaaggttcagtggcagtggatcgnggggcagtntttcaccctnaccatcagcacgtctgcaacctgaaacactttgactaaacttactactgtcagcagtctacaggtacggccggctacgttggccgaggggacgaagcgtaggagacgtacgaacgaactggtggctggctaccatccgttntctcnctccgttcccgcttgtcgtagacgcgacgngtacgcgtgggcgggcgggtcggcggaacg

SEQ ID NO: 341449 - DNA, 517 bp, Homo sapiens
  misc_feature: GZ8MTXP01D2Q05.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggtccatcaaggttcagtggcagtggatcgtggggcagtatttccaccctcaccatcagccagtctgcaacctgaaaacgtactttgactaaacttactactgtcagcagtctacagtacggccggctaccgtttggaccgaggggacgaagcgtaggagagtacgaacgaactgtgctgcacatctgtctcaactccttccgccatctgacgcacgcgagcgtgacgcgggcttgggaacg

SEQ ID NO: 341450 - DNA, 501 bp, Homo sapiens
  misc_feature: GZ8MTXP01B36HN.8.67.G01.1.454.CMB.2.raw
  modified_base (320)..(320): a, c, t, g, unknown or other
  misc_feature (320)..(320): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaatcctgatttatggtgcatccatttcgcaaagtgggtccatcaaggttcagtggcagtggatctggggcagatttcaccctnaccatcagcagtctgcaacctgaaagactttgctaaacttactactgtcagcagtcttacagtaggccggcaccgtttggccaggggacgaagcgtaggagagtacgaacgaacgtgtggctgcacatctgtctcaactcttccgcatctgacgcacgcgagctgagcgggcgttggaacg

SEQ ID NO: 341451 - DNA, 552 bp, Homo sapiens
  misc_feature: GZ8MTXP01EBO67.8.67.G01.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (517)..(517): a, c, t, g, unknown or other
  misc_feature (517)..(517): n is a, c, g, or t
  modified_base (539)..(539): a, c, t, g, unknown or other
  misc_feature (539)..(539): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggcccatcaaggttcagtggcagtggatcgtggggcagtactttcaccctcaccatcagcagtctgacccaacctgaaacgtactttgaacctaaactttctactgtcagctagttctacgagtaggccggactaccgtttggaccgtagggggaacagcgtaggacgagtacgaaacgtaacggtgtacggctaggaccactactcgtcgtcttccacttccctcccgcacttctacgacgacncgcgagcctggacgcgggtcgnggacgaaggcgaa

SEQ ID NO: 341452 - DNA, 576 bp, Homo sapiens
  misc_feature: GZ8MTXP01D91CD.8.67.G01.1.454.CMB.2.raw
  modified_base (346)..(346): a, c, t, g, unknown or other
  misc_feature (346)..(346): n is a, c, g, or t
  modified_base (570)..(570): a, c, t, g, unknown or other
  misc_feature (570)..(570): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagccccaaggaaaacgccccccaaaactcctagatttatggtgcatccatttcgcaaagtgggtccatcaaggttcagtggcagtggatcgtggggcagtattccaccctcaccatcagcacgtcngacaactgaaactactttgactaacttactactgtacagactagtacttacgagggttacgggccggtactaccggtttcggacggaacggggacgaagcgtagggaacgaaggtaccggaaacgtaaccgttggtcggtccgtacgaccaaccttcgtccttcgttccttctaacttccttcccgccttatccgtagacgcacgcgagcgtggagcgggtcgnggaacg

SEQ ID NO: 341453 - DNA, 511 bp, Homo sapiens
  misc_feature: GZ8MTXP01AV9GU.8.67.G01.1.454.CMB.2.raw
  modified_base (318)..(318): a, c, t, g, unknown or other
  misc_feature (318)..(318): n is a, c, g, or t
  modified_base (380)..(380): a, c, t, g, unknown or other
  misc_feature (380)..(380): n is a, c, g, or t
  modified_base (493)..(493): a, c, t, g, unknown or other
  misc_feature (493)..(493): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaatcctgatttatggtgcatccatttcgcaaagtgggcccatcaaggtttagtggcagtggatctggggcagatttcacctnaccatcagcagtctgcaacccctgaagactttgctaaaacttcaactgtcaagcagtcttanagtacgccgggcaccgtttgggcctaggggacgaagcgtgggagatcgaacgactgggtggctgcacatctgtcttcatccttcccgccaatcttgacgcgacgcgagcttgngcggctggcaggcgcaag

SEQ ID NO: 341454 - DNA, 532 bp, Homo sapiens
  misc_feature: GZ8MTXP01DE445.8.67.G01.1.454.CMB.2.raw
  modified_base (273)..(273): a, c, t, g, unknown or other
  misc_feature (273)..(273): n is a, c, g, or t
  modified_base (526)..(526): a, c, t, g, unknown or other
  misc_feature (526)..(526): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagacgacccaaggaaaacgcccccaaactcctgatttatggtgcatccatttcgnaaagtgggtccatcaagttcagtggcagtggatcgtggggcagatttccacctcaccatcagcagtctgcaactgaaagtactttgactaaacttactactgtacagtcagtcttacgagtacggccgggtctaccgtttgggaccgaggggaccgaagcgtagggacgaggtacgaacgaacgtggtaggctgcaccatctgtctcaactccttaccgcatctgacgcacgcgagcgtggacggcgggtcgnggaacg

SEQ ID NO: 341455 - DNA, 548 bp, Homo sapiens
  misc_feature: GZ8MTXP01BPCRM.8.67.G01.1.454.CMB.2.raw
  modified_base (258)..(258): a, c, t, g, unknown or other
  misc_feature (258)..(258): n is a, c, g, or t
  modified_base (516)..(516): a, c, t, g, unknown or other
  misc_feature (516)..(516): n is a, c, g, or t
  modified_base (531)..(531): a, c, t, g, unknown or other
  misc_feature (531)..(531): n is a, c, g, or t
tcagctcgcgtgtccacgaccggtgctcgatttagagtatacatattgggtttgggggcgttttccttgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgccccccaaactcctgatttatggtncatccatttcgacaaagtggggtccccatcaaggttcagtggcagtggatcgtggggcagtatttcacccctcaccatcagcagtctgcccaacctgaagtactttgacctaaactttcactgtcagctagtcttacgagtaggccgggctacgttggaccgagggggacaagcgtaggaagtatacgaaccggaagtggtggctcgacaccatctgtcttcacttccctccccgctacttcgtacgagaccacgcgngccgtgaggcgggcngggccgaaggttcgaac

SEQ ID NO: 341456 - DNA, 504 bp, Homo sapiens
  misc_feature: GZ8MTXP01CN00C.8.67.G01.1.454.CMB.2.raw
  modified_base (482)..(482): a, c, t, g, unknown or other
  misc_feature (482)..(482): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacttttaaatggtatcaacagagcccaaggaaaacgcccccaaatcctgatttatggtgcatccatttcgcaaagtgggtcccatcaaggttcagtggcagtgatcgtggggcagatttcaccctcaccatcagcacgtctgcaacctgaaaagtactttgactaaactttactactgtcagcagtctacagtaggccggcacgtttggccgaggggacgaagcgtaggagagtacgaacgactgtgctgcacatctgtctcaactcttcccgcatctgacgcacgngagcgtgagcggcgttggaacg

SEQ ID NO: 341457 - DNA, 513 bp, Homo sapiens
  misc_feature: GZ8MTXP01AD9P3.8.67.G01.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (450)..(450): a, c, t, g, unknown or other
  misc_feature (450)..(450): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaactcctgatttanggtncatccatttcgcaaagtgggtcccatcaaggttcagtggcagtggatcgtggggcagatttcaccctcaccatcagcagtctgcaaacctgaaaagcctttgctaaactttacactgtcagcagtcttacagtaggccggctaccgttggccaggggacaagctggagagtcgaacgactgtggctgcaccntctgtcttcaatccttcccgccttatcctgacgacacgcgagctggacgcgggcttgggaacg

SEQ ID NO: 341458 - DNA, 515 bp, Homo sapiens
  misc_feature: GZ8MTXP01CBIXB.8.67.G01.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
  modified_base (499)..(499): a, c, t, g, unknown or other
  misc_feature (499)..(499): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggcccatcaaggttcagtgcagtggatcgtggggcagatttcacctcaccatcagcagtctgaccaacctgaagtactttgaacctaaactttcactgtcagctagtcttacagtaggccggcaccgttggccgaggggacaagctaggagatacgaacgacgtgtggctgcaccatctgtcttcatccttcccgccattctgagacncgcgngctggacgcgggcngggacaacgggcaacg

SEQ ID NO: 341459 - DNA, 557 bp, Homo sapiens
  misc_feature: GZ8MTXP01ALABS.8.67.G01.1.454.CMB.2.raw
  modified_base (234)..(234): a, c, t, g, unknown or other
  misc_feature (234)..(234): n is a, c, g, or t
  modified_base (508)..(508): a, c, t, g, unknown or other
  misc_feature (508)..(508): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaacagacgcccaaggaaaacncccccaaatcctagatttatggtgcatccatttcgacaaaggtcgggtcccatcgaaggttcagtggcaggtggatcgtgggggcagtatttccaccctcaccatcagcacgtctgacaacctgaaaacgtactttgactaaacttactactgtcagtcagttcttacgaggtacgggccggctaccgttgggccgaggggacgaagcgtagggagacggtacgaacgtactggtcgctcgacacattctcgttcttctaacttccttcccgcncgtctggacgcgacggccgagcgtgggacggcgggtcgttcgggaaccg

SEQ ID NO: 341460 - DNA, 512 bp, Homo sapiens
  misc_feature: GZ8MTXP01B00OQ.8.67.G01.1.454.CMB.2.raw
  modified_base (318)..(318): a, c, t, g, unknown or other
  misc_feature (318)..(318): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagaccccaaggaaaacgccccccaaaactcctgatttatggtgcatccatttcgcaaagtgggtccatcaaggttcagtggcagtggatcgtggggcagntttcaccctcaccatcagcagtctgcaacctgaaaagtactttgacaaactttactactgtcagcagtctacagtaggccggcaccgttggccgaggggacgaagctaggagagtcgaacgactgtggctgcaccgatctgtcttcaactcttcccgcatcctgacgcacgcagctggacgcgggcttggaacg

SEQ ID NO: 341461 - DNA, 513 bp, Homo sapiens
  misc_feature: GZ8MTXP01DIZXU.8.67.G01.1.454.CMB.2.raw
  modified_base (326)..(326): a, c, t, g, unknown or other
  misc_feature (326)..(326): n is a, c, g, or t
  modified_base (456)..(456): a, c, t, g, unknown or other
  misc_feature (456)..(456): n is a, c, g, or t
  modified_base (509)..(509): a, c, t, g, unknown or other
  misc_feature (509)..(509): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaactcctgatttatggtgcatccatttcgcaaagtgggtcccatcaaggttcagtggcagtggatcgtggggcagatttcaccctnaccatcagcagtctgcaacctgaaatactttgactaaacttactactgtcagcagtcttacagtaggccggcaccgtttggccgaggggacgaagctagggagagtacgaaacgaactggtgctgcaccntctgtcttcaacttcttcccgccatctgacgcacgcgagcgtgaggcgggcgnggcg

SEQ ID NO: 341462 - DNA, 529 bp, Homo sapiens
  misc_feature: GZ8MTXP01CIKDE.8.67.G01.1.454.CMB.2.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaaatcctgatttanggtncatccatttcgcaaagtgggcccatcaaggttcagtggcagtggatcgtgggcagtatttcaccctcaccatcagcagtctgcccaacctgaagtactttgaactaaactttcactgtcagcagtcttacagtaggccggctaccgttggccgaggggacgaagcgtaggagatacgaacgaacgtggtacggctcgcaccgtatcgtcgtcttcacttccttcccgctattcctgacgacncgcgngctgacggcggcgnggacgaaggcgn

SEQ ID NO: 341463 - DNA, 517 bp, Homo sapiens
  misc_feature: GZ8MTXP01D5H9N.8.67.G01.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (463)..(463): a, c, t, g, unknown or other
  misc_feature (463)..(463): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacncccccaaaatcctgatttanggtgcatccatttcgcaaagtgggtccatcaaggttcagtgcagtgatcgtggggcagatttcacctcaccatcagcagtctgcaacctgaaacgtactttgactaaacttactactgtcagcagtcttacagtaggccgggcaccgtttggccgaggggacgaagcgtaggagagtacggaagaactggtggctgcaccatctgtcttnaacttcttcccgcttatctgacgttcacgcgagctggacgcgggcttgggaacg

SEQ ID NO: 341464 - DNA, 542 bp, Homo sapiens
  misc_feature: GZ8MTXP01D53Q4.8.67.G01.1.454.CMB.2.raw
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgacccaaggaaaacgccccccaaaacttcctagtaattttatggtgcatccatttcgacaaaggtcgggtcccatcgaaggttcagtggcagtgatcgtgggcagtatttccaccctcaccatcagcacgtctgacaacctgaaacgtactttgactaaacttactactgtcagtctagtcttaacgaggtacggccgggtactaccgtttgggaccgaaggggacgaagcgtaggagagtacggaagactgtggctgcacgntctgtctnctccttcccgcttagtctgacgcacgngagctaggcgcgggtcnggaacg

SEQ ID NO: 341465 - DNA, 554 bp, Homo sapiens
  misc_feature: GZ8MTXP01EHDZ4.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaatcctgatttatggtgcatccatttcgacaaaggtgggtcccatcaaggttcagtggcagtggatcgtggggcagtatttccaccctcaccatcagcagtctgacaacctgaaaagtactttgactaaacttactactgtacagcagtcttacgaggtacggccggctaccgtttggaccgaggggacgaagcgtaggacgacgtacggaaacgtaacgtggtcggcctgaccacctatcctcgttccttcaacttcccttcccgccttatcctgacgcacggcgagccgtggacggcgggtcgttggaacg

SEQ ID NO: 341466 - DNA, 514 bp, Homo sapiens
  misc_feature: GZ8MTXP01A2UPA.8.67.G01.1.454.CMB.2.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (320)..(320): a, c, t, g, unknown or other
  misc_feature (320)..(320): n is a, c, g, or t
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggcccatcaaggttcagtgcagtggatcgtggggcagtatttcaccctnaccatcagcagtctgacccaacctgaacgtctttgactaactttcactgtcagcagtcttacagtagccggctaccgttggacccgaggggacaagcgtaggganactacgaacgagtgtggctggcacatctgtctcactcctcccgctattcagacgacncgcgncgtgacgcggcnggacaacgggcgaag

SEQ ID NO: 341467 - DNA, 529 bp, Homo sapiens
  misc_feature: GZ8MTXP01A448J.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtgcatccatttcgcaaagtggggtcccatcaaggttcagtgcagtgatcgtgggcagatttcaccctcaccatcagcacgtctgcaacctgaaaacgtctttgactaacttactactgtcagcagtctacgagtaggccggctaccgttggccgtaggggacgaagcgtaggagagtacgaacgactgtgctgcacntctgtcttcgaacttccttcccgcacgtctacgacgcaccggngacgccgtggacggccgggtaacgttcggaaccg

SEQ ID NO: 341468 - DNA, 654 bp, Homo sapiens
  misc_feature: GZ8MTXP01CSZIX.8.67.G01.1.454.CMB.2.raw
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagacttaactttttaaattggtaatacaaacagacgacccaaggaaaacgcccccaaactcctgtatttatggtncatccatttcgacgaaaggtcgggtaccagtacgaaaggttcaggtggctaggtggatcgtggggactagtactttccaccctnaccatcagctacgtctagactaacctagtaaacgtactttgaccttaaacttactacgtgtacaacgtctagttacttacgaggtacgggccgggtactaaccgtttcggggaccgaagggggacgaagcgtagggaacgtaacgggttaacggaaacggtaacgtgggtacgggcctacggaccctaaccgtacttccgttcgttcccttacgtaacctttccccggttaccccgaccttacgtaccgtcgacggaccgacggtccggagtcgtcgggacgggttcgggtcgcgggaacgg

SEQ ID NO: 341469 - DNA, 564 bp, Homo sapiens
  misc_feature: GZ8MTXP01BERS3.8.67.G01.1.454.CMB.2.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggnaagtcagacctattagctactttttaaatggtatacaacagacgacccaaggaaacnccccaaatctgtatttatggtncatctattcgacaaaggtcgggcccatcgaaggttcagtgcagtgatcgtggggctagtactttccaccctcaccatcagcacgtctagacaactgaaaacgtctttgactaaacttacnctagtcatctatctaanggtacggccggactacggttggacgaggggacacgtcgtaggagacggtacggaaacgaacgtggtcggctaggaccaacgtactcgttcgttccttcaacttccttcccgacttacgtcgtagacgaccgacggcgtacgcgtcgggacgggcgggtcgcgggaacg

SEQ ID NO: 341470 - DNA, 599 bp, Homo sapiens
  misc_feature: GZ8MTXP01BCW1K.8.67.G01.1.454.CMB.2.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (386)..(386): a, c, t, g, unknown or other
  misc_feature (386)..(386): n is a, c, g, or t
  modified_base (574)..(574): a, c, t, g, unknown or other
  misc_feature (574)..(574): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggacaagtcagacctattagacttaaccttttttaaatgtatacaacagacgacccaaggaaacnccccaaatcctgtattatggtncatctattcganaaaggtcgggtacccatacgaaggttcagtggacaggtgatcgtggggacagtactttccaccctcacctatcagctacgtcctagacctaacctagaaacgttactttnactaaacttactactgtacagtctagttcttaacgaggtacgggccggtactaccggttggaccgaggggacaagtcgtagggacgtacgtacggaaacgtacgttgacggctcgacctactacttccgtacttcccttctaaccgttcccttacccgccttagtccgtagacgcgacggcgagtcgnggacgggttccggcgttcgggaacg

SEQ ID NO: 341471 - DNA, 574 bp, Homo sapiens
  misc_feature: GZ8MTXP01DKBWP.8.67.G01.1.454.CMB.2.raw
  modified_base (251)..(251): a, c, t, g, unknown or other
  misc_feature (251)..(251): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacccccaatcctgatttatggtncatccatttcgcaaaggtgggtcccatcaaggttcagtggcaggtgatcgtggggcagatttccaccctcaccatcagcagtctgccaacccctgaatactttgaccttaaacttactctcgtacagctagttctacgaggtacggccggtctaccgttggacgaggggacaacgcgtagggagactacgaacgacgtggggtcggctcgacaccgtattctgttaccttctacttccgtcccgctaacttcgttaggacgacgaccggcgaacgttcgttacgggaacgggtcgggcgttagggcgaacggtcgaactaagg

SEQ ID NO: 341472 - DNA, 527 bp, Homo sapiens
  misc_feature: GZ8MTXP01DON8F.8.67.G01.1.454.CMB.2.raw
  modified_base (257)..(257): a, c, t, g, unknown or other
  misc_feature (257)..(257): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatgtatcaacagagcccaaggaaaacgcccccaaatcctagatttatggtncatccatttcgacaaaggtcgggtcccatcaaaggttcagtggcagtggatcgtggggcagtatttcaccctcaccatcagcagtctgacaacctgaaaacgtactttgactaaacttactactgtacagcagtcttagagtacggccgggctaccgtttggaccgaggggacgaagcgtaggagacgtacgaaacgaacgtgtggctcgcacctatctgtctcaactccttcccgcttatcngagcacgcgagctgagcggcgngaacg

SEQ ID NO: 341473 - DNA, 551 bp, Homo sapiens
  misc_feature: GZ8MTXP01D9SJZ.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaaacagagcccaaggaaaacncccccaaatcctgatttanggtncatccatttcgacaaagtgggcccatcaaggttcagtggcagtggatcgtggggnagtatttcaccctcacccatcagcagtctgacccaacctgaagtactttgaacctaactttctatgtcagctagtcttacaggtacggccgggctaccgttggccgtaaggggacgaaggctaggagagtacgaacgaacggtgtggctcgcaccattctcgtcttcacttcccttcccgctattctagacgaccgcgcggcgttcgtcggacggcggggctggggaccaagggcgaacg

SEQ ID NO: 341474 - DNA, 609 bp, Homo sapiens
  misc_feature: GZ8MTXP01BIRPY.8.67.G01.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaacagagcccaaggaaaacnccccaaactcctagatttanggtgcatccattcgnaaagtgggtccatcaaaggttcagtggcagtggatcgtggggcagatttcaccctnaccatcagcagtctgcaacctgaaagtctttgactaacttacactgtcagctagtcttacgagtacggccgggtactaccgtttgggacccgagggggaaccaaggctaggggaacgtagtacggaaacgaaccgttggtacggctcggacctaccctagtccttaggttcctttcaactttccctttcccccggacccttaaagttcccgttaggaacggaaccgttaccggaacggaacggtcgttaacggggacggttaccgggggccttgggggaaccggg

SEQ ID NO: 341475 - DNA, 558 bp, Homo sapiens
  misc_feature: GZ8MTXP01EIXBU.8.67.G01.1.454.CMB.2.raw
  modified_base (256)..(256): a, c, t, g, unknown or other
  misc_feature (256)..(256): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaaattcctgattttanggtgcatccatttcgacaaaggtgggtcccatcaaggttcagtggcagtggatcgtggggcagtatttcaccctcaccatcagcacgtctgacaacctgaaactactttgactaaacttactactgtcagtctagtcttacagtacggccgggctaccgtttggaccgaggggacgagcgtaggagacgtcgaaacgtaacgtggtacgctgccaccgacttcgtgttccttcaacttccttcccggacttactcgtcgacgaccacggccgagtccgtggagggccgggcgttcgggaacg

SEQ ID NO: 341476 - DNA, 599 bp, Homo sapiens
  misc_feature: GZ8MTXP01B7WX6.8.67.G01.1.454.CMB.2.raw
  modified_base (180)..(180): a, c, t, g, unknown or other
  misc_feature (180)..(180): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggnaagtcagaccattagcttaactttttaaatggtatcaacagacgacccaaggaaaaccgccccaaactcctagtatttatggtgcatcctattcgactaaaggtcgggtaccatacgaaggttcaggtgcagtggatcgtgggcagtactttccacctcacatcagctacgtctgaccaactgaaagtactttgactaacttactactgtacagctagttactaacgaggtacgggcccggtctaaccgtttgggaccgaggggacagcgtagggaagacggtacggaaacgtaacgtggtacggcgtacgacctaaccgtattccgtcggttccttcgtaaccttccctttccccgacttacgttcgtacgggacacccgacgcggtacgcgtacggcgggccgggcgttgggaaccg

SEQ ID NO: 341477 - DNA, 631 bp, Homo sapiens
  misc_feature: GZ8MTXP01DIQQ4.8.67.G01.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctccctgtctgcttctataggagacagagtcaccatcacttggccgggacaagtcagacctattagcttaacctttttaaatggtatacaacagacgacccaaggaaaccnccccaaatctagtatttagnggtncatcctattcgactaaaggtcgggtacccagtacgtaaggttcaggtggacgtaggtggatcggtggggactagtactttccacctcacatcagctacgtctagacctaacgtgaaacgttactttcgactaaacttactactgtacagtactagttactacgacggtacgggccggtactacgttcgggaccggaagggggacaaggcgtagggacgtaacggtacggaaacgtaacgttgggtacgctacgacctaaccttcgttcgttacgttccttactaaccttcccgttacccgtacttacgtacgacgacgacgacggcgacgcggtacgggcgggttcgggtcgttaacgggaacg

SEQ ID NO: 341478 - DNA, 589 bp, Homo sapiens
  misc_feature: GZ8MTXP01A410G.8.67.G01.1.454.CMB.2.raw
  modified_base (342)..(342): a, c, t, g, unknown or other
  misc_feature (342)..(342): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagacgacccaaggaaaacgccccccaaaactccctagtattttatggtgcatcctatttcgacaaagtcgggtcccatcaaggttcagtggcagtggatcgtgggggcagtactttccaccctnaccatcagcacgtctgactaacctgaaacgtctttgacctaaactttacctactgtacagtcctagttacttacgaggtacgggcccgggactaacccgtttcgggacccgaagggggaccgaagcgtaggagacggtacgaacggtaactggtcgctcgccacctagtcctgtccttcaacttcccttccccgcttactcgtgacgaccgacgccggagcgtggacggcgggaacgttcgggaacg

SEQ ID NO: 341479 - DNA, 575 bp, Homo sapiens
  misc_feature: GZ8MTXP01C963U.8.67.G01.1.454.CMB.2.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (526)..(526): a, c, t, g, unknown or other
  misc_feature (526)..(526): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggacaagtcagaccattagctaactttttaaatgtatcaacagacgaccaaggaaacncccccaaatcctgtatttanggtncatccatttcgacaaagtcgggtcccatcgaaaggttcagtggcagtgatcgtggggacagtatttcaccctcacatcagcacgtctgacaactgaaaacgtctttgactaaacttactactgtcagtcagttctacgaggtacggccggtctacgttggaccgaggggacagcgtaggagacgtcggaaacgtaacgtggtacggctcggacctaactattcctcggtttccttcaactttcccgtttccccgacttacgttccgngaccggttccaccggcgtagccgtgggacggcgggcgttcgggaaccgg

SEQ ID NO: 341480 - DNA, 564 bp, Homo sapiens
  misc_feature: GZ8MTXP01CZE2F.8.67.G01.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (517)..(517): a, c, t, g, unknown or other
  misc_feature (517)..(517): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaaccttttttaaatggtatcaacagagacccaaggaaaacgccccccaaatcctgatttanggtncatccatttcgcaaagtgggcccatcaggttcagtggcagtggatcgtggggcagactttcnccctnaccatcagcagtctagcccaacctgaagtactttgaaccttaaacttctactgtcagcctagtcttacaggtacggcccggctaccgtttcggcccgagggggacaggcgtaggagacgtacgaacgtaacgtggtggcctgcctaccagttcttacgtcttccgactccgtcccgcgagacgacacggcgngaccgttggacgggccgggtacgcggaccgagggccgngttaaggng

SEQ ID NO: 341481 - DNA, 560 bp, Homo sapiens
  misc_feature: GZ8MTXP01EC8IW.8.67.G01.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatcattcgacaaagtgggcccatcaaggtcagtggcaggtggatcgtggggcagatttcacccctcacccatcagcagtctgaccaacctgaaagtcttttgaacctaactttctactgtcagcagtcttacagtaggccgggtcaccgtttggccgtaagggggacgaaggcgtagggaagacgtacggaaacgaacgggtggtaggtctcgacacctattctcgttcttcacgttcctccccgctacttcctagacgacgcgcggacgctgggaggccgggctcgggacgtaacgggcgaacg

SEQ ID NO: 341482 - DNA, 242 bp, Homo sapiens
  misc_feature: GZ8MTXP01D05WK.8.67.G01.1.454.CMB.2.raw
  modified_base (241)..(242): a, c, t, g, unknown or other
  misc_feature (241)..(242): n is a, c, g, or t
tcagctcgcgtgtccacgaccggtgctcgatttagagtatacatattgggtttgggggctatgttttgacgtctggggccagggaatgttggtcaccgtctcttcagcctccaccaagggcccatcggtcttccccctggcaccctcctccaagagcacctctggggcacagcggccctgggctgcctggtcaaggactacttccgacacgcgagctgagcgggctggcaaggcgcatagnn

SEQ ID NO: 341483 - DNA, 539 bp, Homo sapiens
  misc_feature: GZ8MTXP01BP31W.8.67.G01.1.454.CMB.2.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaanagagcccaaggaaacnccccaaatctgatttanggncatccattcgcaaagtgggtcccatcaaggttcagtgcagtggatcgtggggcagtatttccaccctcaccatcagcagtctgacaacctgaaacgtactttgactaaacttactactgtacagtctagttacttacgaggtacgggccggtactaccgtttcgggaccgaaggggacgaagcgtaggagacgtacgaaacgtactggcgctgcaccgatctagtccttcgaactccgttcccgcttatcgtgacgcacgcgagctggacggttcggcgttggaacg

SEQ ID NO: 341484 - DNA, 567 bp, Homo sapiens
  misc_feature: GZ8MTXP01DIQIB.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaacncccccaaatcctgatttanggtgcatccatttcgcaaagtgggcccatcaaaggttcagtggcagtgatcgtggggcagntttcaccctnaccatcagctagtctgcaacctgaaacgtactttgacctaaactttactactgtacagcctagttacttacgaggttacggcccggggtactacccgtttgggaccctaagggggacaaggtctagggaacgtagtacggaaacggtaactggtacggctggccacctatcgtagtcttcaacgttccttcccgccagttcgtgacgccacgcgagctggacggttcgggaacgttggaaccgg

SEQ ID NO: 341485 - DNA, 649 bp, Homo sapiens
  misc_feature: GZ8MTXP01B9H7S.8.67.G01.1.454.CMB.2.raw
  modified_base (180)..(180): a, c, t, g, unknown or other
  misc_feature (180)..(180): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (355)..(355): a, c, t, g, unknown or other
  misc_feature (355)..(355): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggnaagtcagaccattagctaacctttttaaatggtatcaacagacgacccaaggaaaacncccccaaatcctagtatttagtggtncatcctattcgacaaaggtcgggtcccatacgaaggttcagtggcaggtggatcgtggggcagtactttccaccctcacatcagcacgtcngacaacctgaaaacgtactttgacctaaactttacactgtaccagctagtacttaacgaggtacgggccggtacgtaccgtttcgggaccggtaagggggacgaaggtcgtaagggaacgtaacggtaaccgggtaaacggtaaccgttgggtacggccttacggacctaaccgtacttccgttacgttcctttacgaaccgtttcccttccccggaccttacgttccgtacggaaccgaccgaccggcggtacggtcgtcggggacgggttccggggccgttcgggaacccgg

SEQ ID NO: 341486 - DNA, 514 bp, Homo sapiens
  misc_feature: GZ8MTXP01ATN77.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
  modified_base (428)..(428): a, c, t, g, unknown or other
  misc_feature (428)..(428): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggtcccatcaaggttcagtggcagtggatcgtggggcagtatttcaccctnaccatcagcagtctgcaacctgaaaacgtctttgactaaacttactactgtcagcagtcttacagtaggccggctaccgttggccaggggacaagcgtagganagtcgaacgactggtacgctgcaccatctgtcttcaactcttcccgccatcctgacgcncgcgagctggagccgggtcngggaacg

SEQ ID NO: 341487 - DNA, 544 bp, Homo sapiens
  misc_feature: GZ8MTXP01BGSXM.8.67.G01.1.454.CMB.2.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaanagagacccaaggaaacgcccccaaatcctgtatttanggtgcatcctattcgacaaagtcgggtccatcgaaggttcagtgcagtgatcgngggcagtactttccacctcaccatcagcagtcngacaactgaaatactttgactaaacttactactgtacagtctacgtcttaacgaggtacgggccggtactaaccggttcgggaccgaaggggacgaagcgtaggagacgtacgaacgtanggtgctgcacntctcgtcttctaactcttcccgacttcgtcgtggacncgaccgngacgcgtggacggttcgggtcgcggaacg

SEQ ID NO: 341488 - DNA, 618 bp, Homo sapiens
  misc_feature: GZ8MTXP01DSECQ.8.67.G01.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
tcagctcgcgtgtccacgaccggtgctcgatttagagtatacatattggggtttggggggctcagctcctggggctcctgctactctggctccgaggtgccagatgtgacatccagatgacccagtctccatcctcctgtctgtcttctataggagacagagtcaccatcacttggccgggcaagtcagaccattagctacctttttaaatggtatcaacagacncccaaggaaacnccccaaatcctgtatttanggtncatctatttcgacaaaggtcgggtcccatcgaaaggttcaggtggctaggtggatcggtggggcagtactttccaccctcacctatcagctaacgtctagacctaacctgaaaacgtctttgacctaaacgttactactgtacagactacgttacttacgacgggtacggcccggtactaaccgtttgggacccgtaaggggaacaagtcgtaggacgtaggtacggaacgtaacgtgggtacgcgtcgacctaacctagttccgttggttaccttcgtaacttcccgttcccgacttagtccgtaggacgccttacggcgtacgtccgtgggacggccggggtcgttcgggaaccgg

SEQ ID NO: 341489 - DNA, 564 bp, Homo sapiens
  misc_feature: GZ8MTXP01CWXGL.8.67.G01.1.454.CMB.2.raw
  modified_base (252)..(252): a, c, t, g, unknown or other
  misc_feature (252)..(252): n is a, c, g, or t
  modified_base (328)..(328): a, c, t, g, unknown or other
  misc_feature (328)..(328): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccggcaagtcagaccattagctactttttaaatggtatcaacagagacccaaggaaaacgcccccaaatcctgattttanggtgcatccatttcgcaaagtgggtcccatcaaagtcagtggcagtgatcgtggggcagatttcaccctcacctancgagcacgtcagactaactgaaaactctttcgactaaacttactactgtacagtctagttactaacgaggtacgggccggaccgtacgttcgggaccgaggggaacgagcgtaggagacggtacgaaacgtaacgtggtcgcgtcgaccacctattcgtcgttccttctaacttccttcccgccttacgtctacgacgaccgacggcgacgtcgtaggacggcgggtcgcggaacg

SEQ ID NO: 341490 - DNA, 639 bp, Homo sapiens
  misc_feature: GZ8MTXP01BN9QV.8.67.G01.1.454.CMB.2.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctaacctttttaaatggtatcaacagagacccaaggaaaacncccccaaatcctgatttanggtncatccatttcgacaaaggtgggtcccatcgaaggttcagtggcaggtggatcgtggggactagtactttccaccctcaccntcagcacgtctagacaacctgaaaacgtctttgactaaactttactactgtacagtctagttacttacgaggtacggcccgggtacttaccggtttcgggaccggaagggggtacaacggtcgtagggacgtaacggtacggaaacggtaaccgttgggtcgggacctggaccctaaaccgttcgttccgttcgttaccttaccgtaacctttccccgttacccgtaccttacgtaccgtacggaaccgaccgacggtcggtacgtcgtacgggacgggttccgggtcgttcgggaacg

SEQ ID NO: 341491 - DNA, 637 bp, Homo sapiens
  misc_feature: GZ8MTXP01C6P84.8.67.G01.1.454.CMB.2.raw
  modified_base (178)..(178): a, c, t, g, unknown or other
  misc_feature (178)..(178): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggnaagtcagaccattagctaacctttttaaatggtatcaacagacgcccaaggaaacncccccaaatcctgtatttanggtncatccatttcgacaaaggtcgggtacccatcaaaggttcagtggacaggtggatccgtgggggcagtactttccaccctnaaccatccagcctacgtcagacaaccctgaaaacgtcttttgactaaacttactacgtgacagctagttacttacgacggtacggccgggtactacgtttcgggaccgaacgggggacgaaagtcgtagggacgtaacggtaaccggaaacggtaaaccgtggtacgggacctcggaccaaccgtattccgttacgttcctttaccgtaacgttccctttcccgacccttaattcccggttagaacgaccgaccggtcggaacgtccgttgggacgggccggggtcgttcggaaccggg

SEQ ID NO: 341492 - DNA, 526 bp, Homo sapiens
  misc_feature: GZ8MTXP01BR1YX.8.67.G01.1.454.CMB.2.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (501)..(501): a, c, t, g, unknown or other
  misc_feature (501)..(501): n is a, c, g, or t
tcagctcgcgtgtccacgaccggtgctcgatttagagtatacatattgggtttggggctcagctcctggggctcctgttactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttatggtgcatccattcgcaaagtgggtcccatcaaggttcagtgcagtggatcgtggggcagatttcaccctnaccatcagcagtcctgcaacctgaagtactttgctaaactttacactgtcagctagtcttacagtacggcggtcacgtttggccgaggggacgaagctggagatacgggaacgaacgtgtcggactcgcaccatcgtcgttctcactccttcccgcctattccgtgacgacgcgcgaancgtgacggcgggctcggcgaacggg

SEQ ID NO: 341493 - DNA, 634 bp, Homo sapiens
  misc_feature: GZ8MTXP01COYN4.8.67.G01.1.454.CMB.2.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (595)..(595): a, c, t, g, unknown or other
  misc_feature (595)..(595): n is a, c, g, or t
tcagctcgcgtgtccacgaccggtgctcgatttagagtatacatattgggtttgggggctcagctcctgggggctcctgctactctggctccgaggtgccagatgtgacatccagatgacccagtctccatcctccctgtctgcttctataggagacagagtcaccatcacttggccgggacaagtcagaccattagcttaacctttttaaatggtatacaacagacgacccaaggaaacncccccaaatcctgtatttagnggtnactatcctatttcgacaaaggtcgggtaccagtacgaaggttcagtggactaggtggatcgtgggggactagtactttccaccctcacatcgagctacgtctacgactaaccgtagtaaaacgttactttgaccttaaacttactacgtgtacagtactacgttctacgaggtacggcccggtacgtaccggtttacggggaccggaaggggacgaacgtcgtaggacgtacggtaacggaacgtaacgtggtacgcgtcgacaacctacgttcttcgttccttctaacttccccgttcccgtcttcgtacgtcgaacgaccgaccggngacgcggtacgggacgggttcgggtaacgttcgggaacg

SEQ ID NO: 341494 - DNA, 584 bp, Homo sapiens
  misc_feature: GZ8MTXP01CCLFH.8.67.G01.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatacaacagacgcccaaggaaaacncccccaaatcctgatttanggtgcatccatttcgacaaaggtgggtcccatcgaaggttcagtggcagtggatcgtgggggcagtatttccaccctcaccatcagcacgtctagcaacctgaaacgtactttgactaaacttactactgtcagctagtctacgaggtacggccgggctaccgtttgggaccgaggggaccgaagcgtaggaagacgtacggaaacgtaacgtggtcggactgaccaacctattccgtcgttccttctaacttcccttaccggcccttagttccgtggaacgcgaccgccggtacgcggttacgggcgggccgggccgttgggaaccgg

SEQ ID NO: 341495 - DNA, 555 bp, Homo sapiens
  misc_feature: GZ8MTXP01CBKN1.8.67.G01.1.454.CMB.2.raw
  modified_base (256)..(256): a, c, t, g, unknown or other
  misc_feature (256)..(256): n is a, c, g, or t
  modified_base (484)..(484): a, c, t, g, unknown or other
  misc_feature (484)..(484): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatgtatcaacagagacccaaggaaaacgccccccaaactcctgtatttanggtgcatcatttcgacaaagtgggtcccatcaaggttcagtggcagtggatcgtggggcagtactttccaccctcaccatcagcacgtctagaccaacctgaaacgtactttgactaaacttactactgtacagtacagttcttacgaggtacgggcccgggtctaccgtttcgggaccgtaggggacgagcgtagggacgagtacggaacgactggtggctcgcacntctcgtcttcaacttccttcccgcactacgtgaacgccacggcgagcgtcggacggcggccgttgggaacg

SEQ ID NO: 341496 - DNA, 599 bp, Homo sapiens
  misc_feature: GZ8MTXP01BL833.8.67.G01.1.454.CMB.2.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaccttttaaatggtatcaacagagcccaaggaaaacncccccaaatcctgatttanggtncatcattcgcaaagtgggcccatcaaggttcagtggcaggtggatcgtgggcagactttcaccctcaccatcagcagtctgacccaacctgaagtactttgaacctaactttctactgtacagctagtcttacgacggttacgggccgggtactaccgtttcgggaccggtaagggggacgaacgtcgtagggaacgtacgtaaccggaaacgtaacggtggtacggtccgtacgaccacctacttcgttgtccttacacttccctccccggaactacgttccgtagacgaccgtaccgcgttacggcgtgggacggcggggtcgtacgggactaacgggcgaacg

SEQ ID NO: 341497 - DNA, 495 bp, Homo sapiens
  misc_feature: GZ8MTXP01BX5PM.8.67.G01.1.454.CMB.2.raw
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaaatcctgatttatggtgcatccatttcgacaaagtgggtcccatcaaggttcagtggcagtggatctggggcagatttcaccctnaccatcagcagtctgcaactgaaagctttgctaaacttnactntcagcagtcttacagtaggcggcaccgttggccaggggacagctggagagtcgaagaacngtggctgcaccatcctgtctcngtcttcccgccatcctgacgcacgcgtagctggngcggcgnggcg

SEQ ID NO: 341498 - DNA, 529 bp, Homo sapiens
  misc_feature: GZ8MTXP01EYS53.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (478)..(478): a, c, t, g, unknown or other
  misc_feature (478)..(478): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtgcatccatttcgacaaagtgggtcccatcaaggttcagtgcagtggatcgtggggcagtatttccaccctcaccatcagcacgtctgcaacctgaaagtactttgactaaacttactactgtacagctagtcttacagtacggccgggtctaccgtttggaccagggggaccaagcgtaggagagtacgaacgacgtgtaggctgcacctatctgtcttacnctccttcccgcactctagacgcacggcgagccgtgcggcggcgttggaacg

SEQ ID NO: 341499 - DNA, 612 bp, Homo sapiens
  misc_feature: GZ8MTXP01EAZJJ.8.67.G01.1.454.CMB.2.raw
  modified_base (176)..(176): a, c, t, g, unknown or other
  misc_feature (176)..(176): n is a, c, g, or t
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctaacctttttaaatggtatcaacagacgcccaaggaaaaccncccccaaatcctagtatttatggtncatcctatttcgacaaaggtcgggcccatcgaaggttcaggtggcagtggatcgtggggctagtactttccaccctacaccatcagcacgtctacgacccaaccgtgaaactctttagaaccttaaactttctactgtacagtctacgttcttaacgaggtacgggccggtactaccggttcgggacccgaagggggtaacaaggtcgtaggaacgacgtacgaaacgtacgtgggtacggctacggaccaactacgttcttcgttcttaccgtacttccccttcccggaacttacgcgtagacgacgacggcgttgcgtgggacgggtcggcgtcggacgtaacgggcgaag

SEQ ID NO: 341500 - DNA, 734 bp, Homo sapiens
  misc_feature: GZ8MTXP01DYY5R.8.67.G01.1.454.CMB.2.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctactttttaaatggtatcaanagagccaaggaaacnccccaaatcctgatttanggtncatctattcgacaaaggtcgggacccatctaaggtcaggtgcaggtggatcgtgggcagtacttccacctcaccatcgancagtctcgacccaaccgtagaaagttactttacgaaccttaaacctttaacgtactacggtacctacgtacgtaagtttaccttaaacgtacgggtaccgggacccgggtacctaaccggtttacggggaccggtaaacggggggaccaaagggtcgggtaagggaagtacgtaaaccggaaacggtaacggttcgggtacggggtaccttacggaacctaaccgttaactttccggtttacgtttcctttaaccgtaccgttttcccccgtaccccgtaaccgttaactttcggtacggaaaccggtaacccggtaaccgggaaccccggggttcggttaccgggtaacggggtacccggggtcggggtacggtaccggggaaccggtaacgggccggtaacg

SEQ ID NO: 341501 - DNA, 573 bp, Homo sapiens
  misc_feature: GZ8MTXP01D20N4.8.67.G01.1.454.CMB.2.raw
  modified_base (550)..(550): a, c, t, g, unknown or other
  misc_feature (550)..(550): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatggtatcaacagacgacccaaggaaaacgcccccctaaactcctagtattttagtggtgcatcctatttcgacgtaaaggtcgggtacccatcgaaggttcagtggcaggtggatcgtggggcagtactttccaccctcaccatcagcacgtctgactaaccgtgaaacgtactttgactaaacttactactgtcagtctagtacttacgaggtacggccggactaccgttcggaccgaaggggacgaagcgtaggagacggtacgaaggtagtgcgctgcctaccatcttgtcttcaacttccgttcccgcttacgtcggaacgaccgcggcgaacgtcggnggcggcgggcgtcggaacgaacg

SEQ ID NO: 341502 - DNA, 543 bp, Homo sapiens
  misc_feature: GZ8MTXP01DMCPW.8.67.G01.1.454.CMB.2.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (471)..(471): a, c, t, g, unknown or other
  misc_feature (471)..(471): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatggtatcaacagacgacccaaggaaaacncccccaaactctgtatttanggtncatcatttcgcaaaggtgggtcccatcaaggttcagtggcaggtgatcgtgggcagtactttccaccctcaccatcagcagtctagacaacctgaaacgtactttgactaaactttactactgtacagtacagttacttacgaggtacggccgggtctaccgttggaccgaggggacagcgtaggagagtacgaacgatggtgctgcaccnttctgtcttcaacttccttcccgcagtccgtgacgcacggcgacggcggagggcgggcgtgggaacgaaggg

SEQ ID NO: 341503 - DNA, 601 bp, Homo sapiens
  misc_feature: GZ8MTXP01DB5FS.8.67.G01.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccattcgacaaagtgggcccatcaaggttcagtgcagtggatcgtgggcagtatttcaccctcaccatcagcagtctcgaccaacctagaagtacttttgaaaccttaacttctactgtacaggctaggttctaacgaggttacggccgggtactaccgtttcgggacccgaagggggaccgaagcgtaggaagactacggaaaccgtaagtgggtcgggctacgcctacctattcgttacgtccttactaccttcccttccccggaacctaagttccgagacgtaaccgacggcgacggttcgtaacgggacggtccggggctagggacgaacgggccgtaag

SEQ ID NO: 341504 - DNA, 551 bp, Homo sapiens
  misc_feature: GZ8MTXP01DS7RF.8.67.G01.1.454.CMB.2.raw
  modified_base (176)..(176): a, c, t, g, unknown or other
  misc_feature (176)..(176): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (459)..(459): a, c, t, g, unknown or other
  misc_feature (459)..(459): n is a, c, g, or t
  modified_base (515)..(515): a, c, t, g, unknown or other
  misc_feature (515)..(515): n is a, c, g, or t
  modified_base (536)..(536): a, c, t, g, unknown or other
  misc_feature (536)..(536): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggnaagtcagaccattagctaacctttttaaatggtatcaacagagacccaaggaaaacncccccaaactcctgatttangtncatccattcgacaaaggtgggcccatcaaggttcagtggcagtggatcgtgggcagtatttcaccctcacatcagccagtctcgaccaacctagaacgtactttgaaccttaaactttctactgtacagctagttcttaacgaggtacggccggctaccgttggaccgaagggacgagcgtaggagagtacgaacgacggtgnggctcgactaccatccgttagtcttcacttccttcccgctattcgtgacgaaccgngcgcgcgtgacgggcgggcgngggacgaaggccaag

SEQ ID NO: 341505 - DNA, 574 bp, Homo sapiens
  misc_feature: GZ8MTXP01DHP7N.8.67.G01.1.454.CMB.2.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (491)..(491): a, c, t, g, unknown or other
  misc_feature (491)..(491): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatccctccctgtctgcttctataggagacagagtcaccatcacttggcccgggcaagtcagaccattagcttacctttttaaatggtatcaacagacgacccaaggaaaccncccccaaatcctgtatttatggtncatccatttcgacaaaggtgggtcccatcaaggttcagtggcaggtgatcgtggggcagtatttccaccctcacatcagctacgtctgacctaacctgaaacgtactttcgactaaaccttactacttggtcagtctagttcttacgaggtacggccggtcttaccggttgggaccgaggggacgaagcgtaggacgaaggtcgaaacgtactggtgctgcaacctntccgtgttccttcgaacttcccgttcccgacttacgtcgtagacgccgacggcgagcgtagggcggcgggtcgttcgggaacg

SEQ ID NO: 341506 - DNA, 585 bp, Homo sapiens
  misc_feature: GZ8MTXP01D725U.8.67.G01.1.454.CMB.2.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagagcccaaggaaaacncccccaaatctagatttanggtnctatccatttcgacaaagtcgggcccatcaaggttcagtggcagtgatcgtgggcagtactttcaccctcaccatcgagcagtctcgacccaacctagaaagtactttgaacctaaactttcgtactgtacagtctacggttcttaaacgaggtacgggcccgggtactaccgtttgggacccgaagggggacgaagcgtaggagatacgaaacgaacggtgtacggctcggaccacctattctacgttcttctacttcccttcccgaacctattcgtagaacgaccacgcgagcgtgggacggcgggcgtagggaccgaagggcgaacg

SEQ ID NO: 341507 - DNA, 551 bp, Homo sapiens
  misc_feature: GZ8MTXP01BDQ5Q.8.67.G01.1.454.CMB.2.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggganaagtcagaccattagctaactttttaaatggtatcaacagacgacccaaggaaaccncccccaaatcctagtatttanggtnacatccatttcgacaaaggtgggtacccatcgaaggttcaggtggcaggtgagtcgtgggggcagtactttccaccctcacatcagcacgtctgacaacctgaaacgttactttgactaaacttactactgtacagactagttctacgaggtacggccggtctaccggttcggacggaggggacgagcgaggagagacggaacgacgtgngctgacactntctgtctctcgtccttccgcacgttcgcgacgcgacggccgagccgtggacgggcggtcgttggaaccg

SEQ ID NO: 341508 - DNA, 649 bp, Homo sapiens
  misc_feature: GZ8MTXP01DN7OR.8.67.G01.1.454.CMB.2.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctcctgtctgcttctataggagacagagtcaccatcacttggccgggcaagtcagaccattagctacctttttaaatggtatcaacagacgacccaaggaaaaccncccccaaactcctgtatttatggtncatcctatttcgactaaaggtcgggtacccagtacgaaggttcagtggcagtggatcgtggggacagtactttccaccctcacctatcagcagtctagacaacctgaaactctttgactaactttactactgtacagtctagttacttaacgtagggtacgggtcccgggtactaccggtttcgggaccgggtaagggggaacgaaggcgtagggaacgtacggttacggaaacgtaacgttggtggactcgacctaacctgttccgttcgttacctttccgtaactttcccgtttaccccggaccttaacgtttccgtacggaacggaccgaccgggtcggaacggtccgttggggacggggccgggtccgttaacggggaaccgg

SEQ ID NO: 341509 - DNA, 549 bp, Homo sapiens
  misc_feature: GZ8MTXP01BVOXR.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtgcatccatttcgcaaagtgggtcccatcaaggttcagtggcagtggatcgtgggcagatttcaccctnaccatcagcagtctgcaacctgaaacgtactttgactaaacttactactgtacagtcagttcttacgaggtacgggccgggtctaccgtttgggaccgtaggggacgagctagggacgagtacggaacgactggngctcgactaccatcctagtcttcncgttcccttcccgcatccgtgacgcacggcgacgtcgtggacgggttccgggtcgttcgggaaccg

SEQ ID NO: 341510 - DNA, 599 bp, Homo sapiens
  misc_feature: GZ8MTXP01DAQOT.8.67.G01.1.454.CMB.2.raw
  modified_base (262)..(262): a, c, t, g, unknown or other
  misc_feature (262)..(262): n is a, c, g, or t
  modified_base (514)..(514): a, c, t, g, unknown or other
  misc_feature (514)..(514): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagacgacccaaggaaaacgcccccaaactcctgtatttatggtncatccatttcgacaaagtcgggtcccatcgaaaggttcagtggcagtggatcgtggggcagtactttccaccctcaccatcgagctagtcctagaccaacctggaaaactactttgactaaactttactactgtacagactagttcttacgaggtacgggccgggtactaacccggtttgggaccgaagggggaccaaggctagggaagtacggtaccgaaacggtaactggtaggcctgacctaacccgtnttctcgtccttctaacttcccgttcccgcttacgtcgacgacgacgacgtcggagtcgtacgggacggttccgggtcgcgggaac

SEQ ID NO: 341511 - DNA, 601 bp, Homo sapiens
  misc_feature: GZ8MTXP01A9RSK.8.67.G01.1.454.CMB.2.raw
  modified_base (233)..(233): a, c, t, g, unknown or other
  misc_feature (233)..(233): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (498)..(498): a, c, t, g, unknown or other
  misc_feature (498)..(498): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaccttttaaatggtatcaacagagcccaaggaaaacncccccaaatcctagatttatggtgcatccatttcgacaaaggtcgggtcccatacgaaggttcagtggctagtggatcgtgggcagtatttccaccctnacatcancacgtctgacaacctgaaacgtactttgactaaacttactactgtcagtctagtctacagtacggcggctaccgttggaccgagggacgaagcgtagggagaggtacggaaacgtaacgtggtaggtccgtcgacctacctacgtccgtcgttcccttntaacccgttccccttccccgtaccttaacgttcgttcggaacgaccgaccggtaaccggacggccgttgggaaccgggccggggtaaccgttcggggaaccgg

SEQ ID NO: 341512 - DNA, 577 bp, Homo sapiens
  misc_feature: GZ8MTXP01DCRC4.8.67.G01.1.454.CMB.2.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
  modified_base (486)..(486): a, c, t, g, unknown or other
  misc_feature (486)..(486): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaccttttaaattggatcaacagagcccaaggaaaanccccaaatccngatttanggtgcatccatttcgacaaagtcgggtaccatcaaggttcagtgcagtgatcgtgggcagtatttcacctcaccatcgagcagtctgacaacctgaaaagtctttnactaacttactactgtacagactacgttactacgacggtacggccggtacgtaccgtttacgggacgaacggggacgaacgtcgtagggagtacgtacggaaacgtaactcggtacgctcgacctacctnttccgtcgtaccttctaacttcccgttacccgtaccttacgtacgtacgacgacgaccgaacgacgtcgacggcggacgtcggaacgaacg

SEQ ID NO: 341513 - DNA, 614 bp, Homo sapiens
  misc_feature: GZ8MTXP01CCJOJ.8.67.G01.1.454.CMB.2.raw
  modified_base (175)..(175): a, c, t, g, unknown or other
  misc_feature (175)..(175): n is a, c, g, or t
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
  modified_base (328)..(328): a, c, t, g, unknown or other
  misc_feature (328)..(328): n is a, c, g, or t
  modified_base (593)..(593): a, c, t, g, unknown or other
  misc_feature (593)..(593): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccggnaagtcagaccattagctactttttaaatggtatcaacagacgcccaaggaaaacncccccaaatcctagatttagnggtgctatcctattcgacgaaagtcgggtcccatcaaggtcagtgcagtgatcgtgggcagtacttcaccgtcaccntcagctagtctgacccactagaagtctttgaacctaacttctactcgtacacggtacaacgttcgtaacgtacgggtacgggtacccggggtctaacccggtttgggacccggtaagggggaccgaaagtcgtagggacgactacgggaaacgtacggttgggtacggctacggccaacctgtcgttcgttccttcgtacgttcccgttccccaacctagttccaggaacgtacgacgacggacgttcgtaacggcgccgggacncgggacctaacgggccgtaag

SEQ ID NO: 341514 - DNA, 630 bp, Homo sapiens
  misc_feature: GZ8MTXP01A2NAR.8.67.G01.1.454.CMB.2.raw
  modified_base (244)..(244): a, c, t, g, unknown or other
  misc_feature (244)..(244): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagacctattagacttaaccttttttaaatggtatacaacagacgacccaaggaaaaccncccccaaacttcctagtatttagtggtgctactcctatttcgacgtaaaggtcgggtaccagtacgtaaggttcaggtggacaggtggattcggtaggggacaggtactttccaccctacacatcgagcacgtctacgactaactagaaacgtactttgactaaacgttacctactgtacagtctagttactaacgacggtacgggccgggtacttaccggttcgggaccggacgggggaacgacgtcgtagggacgtacggtacggaacgtaacgtggtacgcgtacgacactacgttcctacgttccttcgtaaccttccgttaccccgtcttagtcgtacggacgcgaccgcggtacgcgtcgggacgggcggtcgcggaacg

SEQ ID NO: 341515 - DNA, 586 bp, Homo sapiens
  misc_feature: GZ8MTXP01DBPC3.8.67.G01.1.454.CMB.2.raw
  modified_base (182)..(182): a, c, t, g, unknown or other
  misc_feature (182)..(182): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
tcagctcgcgtgtccacgaccggtgctcgatttagagtatacatattggggtttgggggctcagctcctgggggctcctgctactctggctccgaggtgccagatgtgacatccagatgacccagtctccatcctccctgtctgcttctataggagacagagtcaccatcacttggccgggnaagtcagaccattagctaacttttaatggatcaacagagacccaaggaaacnccccaaatctgtatttanggtgcatccatttcgacaaaggtcgggtacccatacgaaggttcagtggcaggtggatcgtgggggcagtatttccaaccctnaccatcagctacgtctgacctaaacctggaaaagtacctttgacctaaactttactactgtacagctagttctaacgacggtacgggccgggtactaccggtttgggaccgaagggggacaaagcgtaggagacggtaacggaacgtaacgtggtagcgtgacctaaccgtatcctagtccttctaacttccttacccgacttagtcctaggacgcacgcggaagcgtggacggcgggtcgttcgggaacg

SEQ ID NO: 341516 - DNA, 580 bp, Homo sapiens
  misc_feature: GZ8MTXP01CYREA.8.67.G01.1.454.CMB.2.raw
  modified_base (179)..(179): a, c, t, g, unknown or other
  misc_feature (179)..(179): n is a, c, g, or t
  modified_base (239)..(239): a, c, t, g, unknown or other
  misc_feature (239)..(239): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctaacctttttaaattggtatcaacagacgaccccaaggaaaacnccccccaaactcctagtatttagtggtgctatcctatttcgacaaaggtcgggtacccatcgaaaggttcagtggcaggtggatcgtggggcagtactttccaccctcaccatcagcacgtctgactaacctgaaaacgtctttgactaaacttactactgtacagctagtcttacgagtacggccggtctacgttggaccgtaggggacagcgtggagtacgtacggaacgtaacgtggtacggctgacctacccgtatccgttacgttcttacaacgttccttcccgacttgtcgtgacgttcacgtcgagcgtaggacggttcgggcgttcgggaacg

SEQ ID NO: 341517 - DNA, 584 bp, Homo sapiens
  misc_feature: GZ8MTXP01C6MU0.8.67.G01.1.454.CMB.2.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
  modified_base (544)..(544): a, c, t, g, unknown or other
  misc_feature (544)..(544): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagacctattagcttaacctttttaaattggtatcaacagacgacccaaggaaaccgcccccaaatcctgtatttagngtgcactctatttcgacaaagtcgggtacccatacgaagttcagtgcaggtgatcgtgggacagtactttcaccctcacatcagctacgtctgcaactgaaacgttcttgacctaacttactactgtacagtactattcgttacgaggtacggtcccgggtacgtaaccgtttcgggaccgtacgggggaacaagtcgtagggagacggttaacggaaacgtacgtggtacgcgtcgacctaccgtatccttcgtacttcaacttccttacccgtcagttccngacgttccgacgcgagtccgagggcgcgggtcgcggaacg

SEQ ID NO: 341518 - DNA, 658 bp, Homo sapiens
  misc_feature: GZ8MTXP01EXIA3.8.67.G01.1.454.CMB.2.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgacccaaggaaaacncccccaaaatcctagtatttatggtgcatccatttcgnaaaggtcgggtcccatcaaggtcagtgcagtgatcgnggggcagtatttccaccctcacatcagcacgtctgacaacctgaaaacgtactttgactaaactttacacgttcgtacacgtactagttacctttacgacgggtaacgggcccgggtacttacccggtttcgggaccggaagggggacgaacgcgttagggacgtaaggtacggaaacggtaaccgtgggtacggccttacggaccctaaccgtacgttccgttcggttacccttcgtaacccgtttccctttacccccggccttaaacgttcccgtaagggaaccgttccgaacccgggaacgaacggtcggttcgggacggccgggggtccttcgggggaaccgg

SEQ ID NO: 341519 - DNA, 578 bp, Homo sapiens
  misc_feature: GZ8MTXP01B3IHT.8.67.G01.1.454.CMB.2.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (318)..(318): a, c, t, g, unknown or other
  misc_feature (318)..(318): n is a, c, g, or t
  modified_base (552)..(552): a, c, t, g, unknown or other
  misc_feature (552)..(552): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaacagacgacccaaggaaacncccccaaatcctagtatttatggtnctatcctattcgactaaaggtcgggtcccatcgaaggttcaggtggctaggtggatcgnggggcagtactttccaccctcaccatcagcacgtctgcaactgaaaactctttgactaaacttctacgtgtacagtctacgttactaacgacggtacgggtccggtctaccggtttcgggaccgaagggggactaagccggtaggacgtacgggtacggaaacgtacgtggtacgctcgctaacctgtctcgtctactaacttccttcccgcttctacgtgacgttcacggcgngcgtaggcggccggtcttgggaaccg

SEQ ID NO: 341520 - DNA, 524 bp, Homo sapiens
  misc_feature: GZ8MTXP01EYMT1.8.67.G01.1.454.CMB.2.raw
  modified_base (254)..(254): a, c, t, g, unknown or other
  misc_feature (254)..(254): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgctttctataggagacagagtcaccatcacttgccgggcaagtcagaccattagctactttttaaatggtatcaacagagcccaaggaaaacgcccccaaatcctgtatttanggtgcatccatttcgacaaagtgggtcccatcaaggttcagtggcagtgatcgtgggggcagatttccaccctcaccatcagcagtctgcaacctgaaaacgtctttgactaacttactactgtcagcagtcttacagtacggccggactacgtttggccgaggggacgagcgtaggagacgtacgaacgaactggnggctgcactatcgtgtcttcncttcttcccgcttatctgacgcacgcgagctggacggcgggtcgttggaacg

SEQ ID NO: 341521 - DNA, 653 bp, Homo sapiens
  misc_feature: GZ8MTXP01C8DEO.8.67.G01.1.454.CMB.2.raw
  modified_base (179)..(179): a, c, t, g, unknown or other
  misc_feature (179)..(179): n is a, c, g, or t
  modified_base (238)..(238): a, c, t, g, unknown or other
  misc_feature (238)..(238): n is a, c, g, or t
  modified_base (594)..(594): a, c, t, g, unknown or other
  misc_feature (594)..(594): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctaacctttttaaatggtatcaacagacgacccaaggaaaaccncccccaaatcctagtatttatggtgcatccattcgactaaaggtcgggtacccatcgaaaggttcagtggcagtggatcgtggggcagtactttccaccctcaaccatcgagcacgttctagactaaccgtgaaaagttactttggacctaaacttaactacgtagtcgaacgtcaagtttaccttaacggacggtacgggcccggtactaacccggtttgggaccgaagggggacaaacggtcgtagggagtaacgggtaccggaaagtaaccgtgggtcgacgttcgcctaactacgttcttcgtcctttccgtaacctttcccgttaccccggtacacttaccggtaaggacncccggaaccgaacggtaacggcggtacgggacggggttctaacgggaaccgtaacgggg

SEQ ID NO: 341522 - DNA, 539 bp, Homo sapiens
  misc_feature: GZ8MTXP01DZMQA.8.67.G01.1.454.CMB.2.raw
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggcaagtcagaccattagctacctttttaaatggtatcaacagagacccaaggaaaacgcccccaaatcctgtaatttagtggtgcatccatttcgacaaaggtcgggtccatcaaggttcagtggcagtgatcgtgggacagtatttccaccctcaccatcagcacgtctgaccaactgaaacgtactttgactaaacttactactgtacagctagttctacgaggtacggccggtactaccgtttgggaccgaaggggacgaagcgtaggagagtacgaagtacgtgtgctgcactntctntctcncttccttccncttgtcgtagacgcgacgcgagcgtagggccggcggtcgcggaacg

SEQ ID NO: 341523 - DNA, 655 bp, Homo sapiens
  misc_feature: GZ8MTXP01AIYOV.8.67.G01.1.454.CMB.2.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctactttttaatggtatcaacngagcccaaggaaacnccccaaatcctgtatttanggtncatcctatttcgcaaaggtcgggtcccatcaaggttcagtggcaggtggatcgtggggcagtactttcaccctcaccatcagtcacgtcctagactaaacctggaaaacgtactttgactaaaccttactactgtacagtctagttacttacggaggtacgggcccgggtacttaccgtttcgggaccggtaagggggaccgtaaggcgttagggacgtaacggtacggaacggtaacgtcgggtggtaccgtcgaccgtaaccctattccggtttacgttcccgtttcctaacctttcccgtttaccccgaccttaagtttcccgaacggttaccgaccggaccggaaccgggtacgtccggtaggggaccgggccgggggttccgttcggggaaccggg

SEQ ID NO: 341524 - DNA, 788 bp, Homo sapiens
  misc_feature: GZ8MTXP01CBTDZ.8.67.G01.1.454.CMB.2.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttggccggcaagtcagaccattagctactttttaatggtatacaacagacgaccaaggaaacaccccaaactcctagtatttatggtgactatctatttcgactaaaggtcgggacccatacgaaggttcaggtggcgtagtggtagtcgtggggcagtactttaccacccctacacgactcgagacctagttctacgaccccaaaccgttacgaacgttacctttacggaaacccttaactttaaccgtacgtacggtaccgtagtaaccgtacggtttaccttaaacggacggggttacccggggaccccgggtccctttaaaccggggtttcgggaacccggggtaaacggggggaccggtaaacgggtaccggtagggaaacggtaacggtaacccgggaaacggttaaccgggttggggtccggtaacgttaccggaacctacccttaacgtttccgttacgtttacctttacccttaccggttcccctttaacccccggcttaaacgttccggttacggaaaccgttaaccggtcgttacccggggacgttccgggtaacggggcgggtaaccccgggggttacgtaccgggaacggtaacggggcccgtaacgg

SEQ ID NO: 341525 - DNA, 614 bp, Homo sapiens
  misc_feature: GZ8MTXP01DRO96.8.67.G01.1.454.CMB.2.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
tcagctcgcgtgtccacgaccggtgctcgatttagagtatacatattgggtttgggggctcagctcctggggctcctgctactctggctccgaggtgccagatgtgacatccaggtgacccagtctccatcctccctgtctgcttctataggagacagagtcaccatcacttgccgggcaaatcagaccattagctacttttaatgtatcaanagagccaggaaacncccaaactcctagtattanggtgcatctattcganaaaggtcgggtcccatacaaggttcagtggcaggtgatgtgggctagtatttccaccctcaccatcagctagtccagacaactgaacgtaacttagctaaacttactactcgtacagcgtactcttaagaggtacgggccggtctaccgttggaccggaggggactaagcgtgggaagtactaacggggaaacgtaacgtcgggtacggacttacgccgaaaccctagtttaccgttcggttacccttttcgaaccctttccctttccccggaactacttcgaacggtacgaccgcgacgggtcgtaaccggttggaacggggtcgggaccgttggggaacccgtaacgggg

SEQ ID NO: 341526 - DNA, 571 bp, Homo sapiens
  misc_feature: GZ8MTXP01DRXS8.8.67.G01.1.454.CMB.2.raw
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagacctattagctactttttaaatgtatcaacagacgacccaaggaaaccnccccaaactcctagtatttatggtncatctattcgacgaaaggtcgggtacccatcgaaggttcaggtggcaggtggatcgtgggcagtactttcccaccctcaccatcagcacgtctagacctaaccgtgtaaaacgtactttcgactaaactttactactgtacagctacgttcttacgacggtacggccggtactacgttggaccgtaggggacgagcgtaggagaggacgaaagtactggtgctcgactaacgtctctgttccttcaacttccgttcccgacttacgtctgacgcgacgcggacgcgtggacgggcggtcgttcgggaacg

SEQ ID NO: 341527 - DNA, 666 bp, Homo sapiens
  misc_feature: GZ8MTXP01BJG30.8.67.G01.1.454.CMB.2.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctccctgtctgcttctataggagacagagtcaccatcacgttggccgggacaagtcagacctattagacttactttttaatggtatcaacagacgacccaaggaaaccnccccaaatcctagtatttagnggtnactatacctatttcgactaaacggtcgggtaccagtacgaggttcaaggtggactaggtgtagtcgtagggggacagttactttccaccctcacctatcgacgctacggtactacgactaaccgtagtaaaacgttcttaacgacttaaacttactacgtgtacagttcacgttactaacggacgggtacgggtccggactttacggttcggggaccggaagggggacgaacggttcgaggggtaacgtagggttaccgggaaacgtacgttgggacggtactcgactaactcgttcgtcgttccttccgaacgtttcccttacccgtacttacgtcgtaacgggaccacggaccggcgtacgggcgtaacgggcgggccgggtaacgttcgggaaccgg

SEQ ID NO: 341528 - DNA, 619 bp, Homo sapiens
  misc_feature: GZ8MTXP01AIUOU.8.67.G01.1.454.CMB.2.raw
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatccctccctgtctgcttctataggagacagagtcaccatcacttgccgggcaagtcagaccattagactaactttttaaatggtatcaacagacgacccaaggaaaaccncccccaaacttcctagtatttagtggtnctatcctattcgactaaaggtcgggtacccatacgtaaggttcaggtggcaggtggagtcgtgggggactagtactttccaaccctcaccgatcagcagtcagactaactgaaacgtctttcactaaacttctactgtacagtctacgtcttaacgacggtcgggcccggtctacccggttggaccggaaggggaccgtagtacgaggacgaggtacgaacggtagtcggtacggcctacgacctaccagttcctgttaccttcgtaacttccccgttcccgacttacgttaccgtagaccgcgaccggtccggacgccggtcgggacgggttcgggccgttcgggaaccgg

SEQ ID NO: 341529 - DNA, 595 bp, Homo sapiens
  misc_feature: GZ8MTXP01C9SHF.8.67.G01.1.454.CMB.2.raw
  modified_base (179)..(179): a, c, t, g, unknown or other
  misc_feature (179)..(179): n is a, c, g, or t
  modified_base (314)..(314): a, c, t, g, unknown or other
  misc_feature (314)..(314): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctacctttttaaatggtatcaacagacgacccaaggaaaacgcccccaaactcctgtatttatggtgcatccatttcgacaaaggtgggtcccatcaaggttcagtggacaggtgatcgnggggcagtactttccaccctcaccatcagctagtctgacaacctgaaaacgtactttgactaaacttactactgtacagctagttcttacgaggtacggccgggtactaccgtttcgggaccgaagggggacgaagcgtagggacgtacggtaacggaacgtaacgtcggtaggtcctgaccgaaccctagtttcctcgttccttctaacttcccttcccgccttacttcgtcgaacgacaccggcgtacggcgtggacgggcgggtcgttcgggaaccgg

SEQ ID NO: 341530 - DNA, 506 bp, Homo sapiens
  misc_feature: GZ8MTXP01ALYEG.8.67.G01.1.454.CMB.2.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctcctgtctgcttctataggagacagagtcaccatcacttgccgggcaagtcagaccattagctaactttttaaatggtatcaacagagcccaaggaaaacncccccaaatctgatttanggtncatccatttcgacaaagtgggcccatcgaaggttcagtggcagtggatcgtgggcagtctttcacctnaccatcagcagtctgacccaactgaagtactttgactaactntactgtcagctagtctacagtagcggctacgttgcgagggacaggctggagagtacgaacgacgtgtaggctgcacgatctgtctcactctcccgcacttntacgagcacgcgacgttcnggngcgggtcgnggctaaggcgaag

SEQ ID NO: 341531 - DNA, 568 bp, Homo sapiens
  misc_feature: GZ8MTXP01E2Y86.8.67.G01.1.454.CMB.2.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (400)..(400): a, c, t, g, unknown or other
  misc_feature (400)..(400): n is a, c, g, or t
  modified_base (469)..(470): a, c, t, g, unknown or other
  misc_feature (469)..(470): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatgtatcaacagagcccaaggaaaacnccccaaatcctgatttangtgcatccatttcgctaaagtcgggtacccagtcaaaggttcagtggcagtggatcgtgggcagtatttcgaaccctcgaccatcagcagtctgacaacctgaaaacgactttgactaaacttacgctgtccgaagctagtaccttaanagtacggccgggactacgtttggaccgaggggacgaagacgtaggagacgtcgaaacgtactaggcggnngactacactgtctcttacaacttccttacccgccttaatccgttagacgaacacggcccgtacgaagttccgagggttccggggtcgttaacggaacg

SEQ ID NO: 341532 - DNA, 690 bp, Homo sapiens
  misc_feature: GZ8MTXP01CRJDL.8.67.G01.1.454.CMB.2.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (539)..(539): a, c, t, g, unknown or other
  misc_feature (539)..(539): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctactttttaaatgtatcaangagcccaagaaacnccccaaatctgtatttanggtncatccatttcgacgtaaacggtcgggtaccccagtcgtaaggttcgaaggttcggacgtaaggttcgggactaccggttgggggacctaaggtaccttttaccacccccttacaaccccgtaagtccgtaagccgtaacggtccttacggaccccctaaacccgtaggaacgttaccgttttacggaaaccttaaactttaacgtaacgtgtacacgactacgttacttaacgacgtacgggcccggtacttaccggttcggacccggtagggggacgaagcgtacggganaacgttacggaaacgtagggtcggtaggtaccgtcgactacctacgttctcgttcttactcgttcccgttccccgctagttcctagacgaccgtcgacggacgttcggtaacgggacggtcccggtacggtacgggaccgtaaggccgaag

SEQ ID NO: 341533 - DNA, 505 bp, Homo sapiens
  misc_feature: GZ8MTXP02I3E19.8.67.G01.1.454.CMB.2.raw
  modified_base (323)..(323): a, c, t, g, unknown or other
  misc_feature (323)..(323): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaactcctgatttatggtgcatccatttcgcaaagtgggtcccatcaaggttcagtggcagtggatctggggcagatttcaccctnaccatcagcagtctgcaacctgaaacgctttgactaaacttactactgtcagcagtcttacagtaggccggctaccgtttggccgaggggacgaagcgtaggagatacgaacgactggtagctgcaccatctgtcttcacttcctccgcatctcgacacacgcgagctgacgcggctggacg

SEQ ID NO: 341534 - DNA, 483 bp, Homo sapiens
  misc_feature: GZ8MTXP02I9TXK.8.67.G01.1.454.CMB.2.raw
  modified_base (317)..(317): a, c, t, g, unknown or other
  misc_feature (317)..(317): n is a, c, g, or t
  modified_base (480)..(480): a, c, t, g, unknown or other
  misc_feature (480)..(480): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaatcctgatttatggtgcatccattcgcaaagtgggtcccatcaaggttcagtggcagtgatctgggcagatttcaccctnaccatcagcagtctgcaactgaagctttgctaaacttactactgtcagcagtcttacagtaggccggcacgttggccaggggacgaagctaggagatcgaacgaactgtagctgcacatctgtctcactctccgcatctgacgcacgcgagcgtgagcggcgngcg

SEQ ID NO: 341535 - DNA, 502 bp, Homo sapiens
  misc_feature: GZ8MTXP02JM8Q3.8.67.G01.1.454.CMB.2.raw
  modified_base (322)..(322): a, c, t, g, unknown or other
  misc_feature (322)..(322): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaaacagagcccaaggaaaacgcccccaaaactcctgatttatggtgcatccatttcgcaaagtgggtcccatcaaggttcagtggcagtggatctggggcagatttcaccctnaccatcagcagtctgccaacctgaaagactttgacaaacttctactgtcagcagtcttacagtagccggcactttggccaggggacaagctggagatcgaaacgaactgtggctgcaccatctgtcttcatcttcccgccatcctgagacacgcgagctgagcgggctggcaagggcacg

SEQ ID NO: 341536 - DNA, 507 bp, Homo sapiens
  misc_feature: GZ8MTXP02HGEXP.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggcaagtcagaccattagctacctttttaaatggtatcaacagagcccaggaaaacgccccaaactcctgatttatggtgcatccatttcgcaaagtgggtcccatcaaggttcagtgcagtgatcgtggggcagatttcaccctcaccatcagcagtctgcaactgaagtactttgctaacttactactgtcagcagtcttacagtaggccggctaccgtttcggccgaggggacgagcgtaggagagtcgaacgaactggtgctgacacatctgtcttcactccttcccgccatctcgacgacacgcgagcgtgacggcggcgtcggacg

SEQ ID NO: 341537 - DNA, 500 bp, Homo sapiens
  misc_feature: GZ8MTXP02GV5L9.8.67.G01.1.454.CMB.2.raw
  modified_base (322)..(322): a, c, t, g, unknown or other
  misc_feature (322)..(322): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaactcctgatttatggtgcatccatttcgcaaaggtgggtcccatcaaggttcagtgcagtgatcgtgggcagatttcacctnaccatcagcagtctgcaacctgaagtactttgactaaacttactactgtcagcagtcttacagtaggccggctacttggccaggggacgaagcgtggagatcgaacgactggtagctgcacatctgtctcactcttccgctatctcgacgacacgcgacgcgtgacgcggcgtggacg

SEQ ID NO: 341538 - DNA, 501 bp, Homo sapiens
  misc_feature: GZ8MTXP02GJV4U.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaactcctgatttatggtgcatccatttcgcaaagtgggtcccatcaaggttcagtggcagtggatcgtggggcagatttcaccctcaccatcagcagtctgcaacctgaaagactttgcaaacttactactgtcagcagtcttacagtacgccgggctaccgtttggccaggggacgagcgtaggagatcgaacgactggtgctgcacatctgtcttcactctcccgcatctcgacgacacgcgacgctgacgcggcaggacg

SEQ ID NO: 341539 - DNA, 508 bp, Homo sapiens
  misc_feature: GZ8MTXP02F12O2.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaatcctgatttatggtgcatccatttcgcaaagtggggtcccatcaaggttcagtggcagtggatcgtggggcagatttcaccctcaccatcagcagtctgcaacctgaagctttgctaaacttactactgtcagcagtcttacagtaggccggcaccgtttggccagggggacaagcgtggagatcgaacgactgtaggctgacaccatctgtcttcactcttcccgcctatcctgacgacacgcgagctaggacggcgggctggacg

SEQ ID NO: 341540 - DNA, 534 bp, Homo sapiens
  misc_feature: GZ8MTXP02H8BNQ.8.67.G01.1.454.CMB.2.raw
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
  modified_base (384)..(384): a, c, t, g, unknown or other
  misc_feature (384)..(384): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctaccttttttaaatggtatcaacagagcccaaggaaacgcccccaaatcctgatttanggtgcatccatttcgcaaagtggggtcccatcaaggttcagtggcagtgatcgtggggcagatttcaccctnaccatcagcagtctgcaacttgaagtactttgactaaacttactactgtcagcagtctanagtacggccggctacgtttggaccgaggggacgaagcgtagggagatacggaaacgaacgtggtaggcgtcgacacctatccgttgtcttctactccgtttccccgctactcctagacgacacgcgacgcgtaggacgcgggctcggacg

SEQ ID NO: 341541 - DNA, 501 bp, Homo sapiens
  misc_feature: GZ8MTXP02F4QS3.8.67.G01.1.454.CMB.2.raw
  modified_base (323)..(323): a, c, t, g, unknown or other
  misc_feature (323)..(323): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaatcctgatttatggtgcatccatttcgcaaagtgggtcccatcaaggttcagtggcagtggatctggggcagatttcaccctnaccatcagcagtctgcaacctgaagactttgacaaacttactactgtcagcagtcttacagtaggccggcaccgttggccaggggacgaagctagggagatcggaacgaactgtggctgcaccatctgtcttcacttcttcccgccatctgacgcacgcgagctgagcgggctggacg

SEQ ID NO: 341542 - DNA, 499 bp, Homo sapiens
  misc_feature: GZ8MTXP02IXGT1.8.67.G01.1.454.CMB.2.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacnccccaaactcctgatttanggtgcatccatttcgcaaagtgggtcccatcaaggttcagtggcagtgatcgtgggcagatttcacctnaccatcagcagtctgcaacctgaagtctttgctaacttactactgtcagcagtctacagtaggccggcacgtttggaccgaggggacgaagcgtaggagtagtacgaacgtactgtagctgcacatctgtctcactcttcccgctactctgacgtacacgcgagctgagcggctggacg

SEQ ID NO: 341543 - DNA, 481 bp, Homo sapiens
  misc_feature: GZ8MTXP02H17CH.8.67.G01.1.454.CMB.2.raw
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccggcaagtcagaccattagcacctttttaaatggtatcaacagagcccaggaaaancccccaaactcctgatttatggtgcatccatttcgcaaagtgggtcccatcaaggttcagtgcagtggatctggggcagatttcaccctnacatcagcagtctgcaactgaagactttgcaacttactactgtcagcagtctacagtagcggcactttggccaggggacagctggagatcgaacgaactgtgctgcaccatctgtcttcatcttcccgcatctgacgacacgcgagctgacgcggctggacg

SEQ ID NO: 341544 - DNA, 501 bp, Homo sapiens
  misc_feature: GZ8MTXP02HDY0W.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgcccccaaactcctgatttatggtgcatccatttcgacaaagtgggtcccatcaaggttcagtggcagtggatcgtggggcagatttcaccctcaccatcagcagtctgcaacctgaaagactttgcaaacttactactgtcagcagtcttacagtaggcggcactttggcgaggggacgaagcgtaggagatacgaacgaactgtggctgcaccatctgtcttcactcttccgcctatctgacgacacgcgagctgagcggctggacg

SEQ ID NO: 341545 - DNA, 510 bp, Homo sapiens
  misc_feature: GZ8MTXP02HM34X.8.67.G01.1.454.CMB.2.raw
  modified_base (322)..(322): a, c, t, g, unknown or other
  misc_feature (322)..(322): n is a, c, g, or t
  modified_base (489)..(489): a, c, t, g, unknown or other
  misc_feature (489)..(489): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaacagagcccaaggaaaacgcccccaaactcctagatttatggtgcatccatttcgcaaagtgggtcccatcaaggtcagtgcagtgatcgtgggcagatttcaccctnaccatcagcagtctgcaactgaagtactttgactaacttactactgtcagcagtcttacagtaggccggctacgtttggccaagggggacaagctaggagtatcgaaacgacgtggtggctgcaccgatctgtctcactccgttcccgccatcctgacgacacgcgngcgtgacggcggactcggacg

SEQ ID NO: 341546 - DNA, 561 bp, Homo sapiens
  misc_feature: GZ8MTXP02IY6XC.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (326)..(326): a, c, t, g, unknown or other
  misc_feature (326)..(326): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccggcaagtcagaccattagctacctttttaaatggtatcaacagagcccaaggaaaacncccccaaatcctgatttanggtncatccattcganaaaggtgggtcccatcaaggttcagtgcagtgatcgtggggcagtatttccaccctnaccatccagcagtctgacaactgaagtactttgactaaacttactactgtacagctagttcttacaggtacgggccggtctaccgtttcgggaccgagggggaaccgaagcgtagggaacgtagtacggaaacgaactgggacggctgacctaccagtcgttacgtcttctactccgttcccgcctatcgtcgaacgtaccacgaacgacgcgtacggacggcggtcgcggaacg

SEQ ID NO: 341547 - DNA, 518 bp, Homo sapiens
  misc_feature: GZ8MTXP02J3H9G.8.67.G01.1.454.CMB.2.raw
  modified_base (250)..(250): a, c, t, g, unknown or other
  misc_feature (250)..(250): n is a, c, g, or t
  modified_base (456)..(456): a, c, t, g, unknown or other
  misc_feature (456)..(456): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaaggaaaacgcccccaaatcctgatttanggtgcatccatttcgcaaagtggggtcccatcaaggttcagtggcagtgatcgtggggcagatttcaccctcaccatcagcagtctgcccaaaccgtgaagtactttgctaacttcactgtcagcagtcttacagtacggccggctaccgtttggcccagggggacaagctagggagatacgaacgaactgtggctgcaccattcngtcttcatccgttccncatcncgacgacacgcgacgcgngacgcggcgcggcgacggcgacg

SEQ ID NO: 341548 - DNA, 518 bp, Homo sapiens
  misc_feature: GZ8MTXP02HJO4S.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaacgcccccaaactcctgatttatggtgcatccatttcgcaaagtgggtcccatcaaggttcagtggcagtggatcgtggggcagatttcaccctcaccatcagcagtctgcaactgaagctttgactaacttacactgtcagcagtcttacagtacggccgggctaccgtttggccgtagggggacgaagcgtagggagactacggaacgtaacgtggtggctgacaccgatctacgtcttcactccttcccgctatctgacgacacgcgagctggagcggactggacg

SEQ ID NO: 341549 - DNA, 499 bp, Homo sapiens
  misc_feature: GZ8MTXP02HBSRP.8.67.G01.1.454.CMB.2.raw
  modified_base (390)..(390): a, c, t, g, unknown or other
  misc_feature (390)..(390): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaaagcccccaaatcctgatttatggtgcatccatttcgcaaagtggggtcccatcaaggttcagtggcagtggatctggggcagatttcacctcaccatcagcagtctgcaacctgaagactttgactaaacttactactgtcagcagtctacagtaggccggnaccgtttggccgaggggacgaagcgtggagatcgaagactgtggctgcacatctgtcttcactcttcccgctactctgacgacacgcgagcgtagacgcgggctggacg

SEQ ID NO: 341550 - DNA, 507 bp, Homo sapiens
  misc_feature: GZ8MTXP02JXRPW.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgccccccaaatcctgatttatggtgcatccatttcgcaaagtggggtcccatcaaggttcagtggcagtggatctggggcagatttcaccctcaccatcagcagtctgcaacctgaagactttgcaaacttactactgtcagcagtcttacagtaggccgggcacctttggccgaggggacgaagcgtaggagagtacgaacgaactggtggctgcaccatctgtcttcactccttccgccatctgacgacacgcgagcgtgaggcggctggacg

SEQ ID NO: 341551 - DNA, 519 bp, Homo sapiens
  misc_feature: GZ8MTXP02FU54K.8.67.G01.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgtctttctataggagtaacagagtcaccatcacttgccgggcaagtcagaccattagctaccttttaatgtatcaacaganccagaaacnccccaaatccngattatgtgcatccatttcgcaaagtgggtcccatcaagttcagtgcagtgatcgtggggcagatttcaccctcaccatcagcagtctgcaacctgaagactttgactaacttactactgtcagctagtcttacagtacggccggtcctacgttcggaccgtagggggacgaaagcgtagggagaacgtacgaaacgtaccgtaggtggacctggaccacctagttctgtcttcactctccgcatctgacgcacgcgagctcgaggcggcgtggacg

SEQ ID NO: 341552 - DNA, 532 bp, Homo sapiens
  misc_feature: GZ8MTXP02F79HB.8.67.G01.1.454.CMB.2.raw
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgcccccaaatcctgatttatggtgcatccatttcgcaaagtggggtcccatcaaggttcagtggcagtggatcgtggggcagatttcaccctcaccatcagcagtctgcccaacctgaaagtactttgacctaactttctactgtcagcagtcttaacagtaggccggcaccgttggccgagggggacgaagcgtaggagatacggaaacgaacgtgtggctggcaccgatctgttcttcattccttcccgcctatctacgacgtacacgcgagctggacgcggggctgggacaacggcgacg

SEQ ID NO: 341553 - DNA, 515 bp, Homo sapiens
  misc_feature: GZ8MTXP02GPKYA.8.67.G01.1.454.CMB.2.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacncccccaaatcctgatttanggtgcatccatttcgcaaagtgggtcccatcaaggttcagtgcagtggatctggggcagatttccacctcaccatcagcagtctgcaacctgaactactttgcaaacttactatgtcagcagtcttacagtacggccggctaccgttggaccgtaggggacgaagcgtaggagacgtcgaaacgaacgtggtggactgcaccagtcctagtcttcactcgttcccgctatcctagacgacacgcgagctggacgcggctggacg

SEQ ID NO: 341554 - DNA, 527 bp, Homo sapiens
  misc_feature: GZ8MTXP02G3UN3.8.67.G01.1.454.CMB.2.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (515)..(515): a, c, t, g, unknown or other
  misc_feature (515)..(515): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccattcgacaaagtgggtcccatcaaggttcagtggcagtggatcgtggggcagatttcaccctcaccatcagcagtctgccaaacctgaaagtacttttgactaaactttctactgtcagctagtcttaacagtaggccggcaccgtttggccgaggggaccgaagcgtaggagatacggaaacgtaacgtggtagctgaccaccatctgtcttcactccttcccgctacttcacgacgacacgcagctgagcggcnggacaacggcac

SEQ ID NO: 341555 - DNA, 507 bp, Homo sapiens
  misc_feature: GZ8MTXP02HDRSJ.8.67.G01.1.454.CMB.2.raw
  modified_base (253)..(253): a, c, t, g, unknown or other
  misc_feature (253)..(253): n is a, c, g, or t
  modified_base (487)..(487): a, c, t, g, unknown or other
  misc_feature (487)..(487): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttanggtgcatccattcgacaaagtgggtcccatcaagttcagtgcagtgatcgtgggcagatttcacctcacatcagcagtctgcaactgaacgactttgactaaacttactactgtcagcagtctacagtaggccgggcaccgtttggccgaggggacgagcgtaggagagtacggaacgaactggtaggctgcacagtctgtcttcatccttccgccactctcgacgacacgcgngactggagtcggcgtggacg

SEQ ID NO: 341556 - DNA, 552 bp, Homo sapiens
  misc_feature: GZ8MTXP02HKFEY.8.67.G01.1.454.CMB.2.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacncccccaaatcctgatttanggtncatccatttcgacaaagtcgggtcccatcaagttcagtgcagtggatcgtgggcagatttccaccctcaccatcagtcagtctgacaaccgtgaagtctttgactaaacttactactgtcagcagtcttacagtacggccggctacgttcggacgagggggacaagcgtaggagacgtacgaaacgaacgtggtacggctcggacacccattccttgtcttcctactccctttccccgactattcgtacgaacgaccgaacgcggacgcgtacggacggccggggagtcgggaccg

SEQ ID NO: 341557 - DNA, 509 bp, Homo sapiens
  misc_feature: GZ8MTXP02H1V23.8.67.G01.1.454.CMB.2.raw
  modified_base (249)..(249): a, c, t, g, unknown or other
  misc_feature (249)..(249): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaggaaagcccccaaactcctgatttanggtgcatccatttcgcaaagtgggtcccatcaaggttcagtggcagtggatcgtggggcagatttcacctcaccatcagcagtctgcaacctgaagtactttgactaacttactactgtcagcagtctacagtaggccgggctaccgtttggccgagggggacgaagcgtaggagactacggaacgaacgtggtggctgacaccatctgtcttcactcttcccgctactctgacgacacgcgagctgagcgggctggacg

SEQ ID NO: 341558 - DNA, 514 bp, Homo sapiens
  misc_feature: GZ8MTXP02IR7TI.8.67.G01.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacnccccaaactcctgatttanggtgcatccatttcgcaaagtgggtcccatcaaggttcagtggcagtggatctggggcagatttcaccctcaccatcagcagtctgcaaactgaaagactttgcaacttactacctgtcagcagtcttacagtacgggccgggcaaccttttgggaccgagggggaccgaaagcgttaggagatacgaaacgactggtgctgcaccatctgtctcactccttccgccactctgacgacacgcgagcgcgagcggcgcgcg

SEQ ID NO: 341559 - DNA, 500 bp, Homo sapiens
  misc_feature: GZ8MTXP02FJ1LH.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaacgcccccaaaactcctgatttatggtgcatccatttcgcaaagtggggtcccatcaaggttcagtggcagtggatcgtggggcagatttcaccctcaccatcagcagtctgcaacctgaagactttgcaacttactactgtcagcagtcttacagtaggccgggcaccgtttggccgaagggggacgaagcgtggagatcgaacgaactgtggctgcacatctgtctcactctcccgcatctgacgcacgcgagctgagcggctggacg

SEQ ID NO: 341560 - DNA, 549 bp, Homo sapiens
  misc_feature: GZ8MTXP02IKK35.8.67.G01.1.454.CMB.2.raw
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgtatttatggtgcatccatttcgcaaagtgggtccatcaaggttcagtggcagtggatcgtgggcagtatttcaccctcaccatcagcagtctgccaacctgaagtactttgactaacttctactgtacagcagtcttacagtaggcccgggtacacgtttcggccgagggggaccgaagcgtaagggaaactacgaaacgaacgtggtcgggcctagccaccatcgtgtcttcacttccttcccgctactcgtgacgacacgcgacgcgtagaacggtcgggacgtcggacacggccgacgtag

SEQ ID NO: 341561 - DNA, 533 bp, Homo sapiens
  misc_feature: GZ8MTXP02G07H4.8.67.G01.1.454.CMB.2.raw
  modified_base (235)..(235): a, c, t, g, unknown or other
  misc_feature (235)..(235): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaccttttttaaatggtatcaacagagcccaaggaaaacnccccaaatcctgatttatggtgcatccattcgacaaagtgggtcccatcaaggttcagtgcagtggatcgtgggcagatttcaccctcacatcagcagtctgcaacctgaaagtactttgactaaacttactactgtcagcagtctacagtacggcggctacgttcggcgagggggacaagcgtagggaagactacggaaacgtaacgtggtggacctggaccaaccatcctgttcttcactccttcccgcactcgtcgaacgacacgcgacgcgtaggacgccggggcgtacggacg

SEQ ID NO: 341562 - DNA, 502 bp, Homo sapiens
  misc_feature: GZ8MTXP02ILIUY.8.67.G01.1.454.CMB.2.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagccaggaaaanccccaaactcctgatttanggtgcatccattcgacaaagtgggtcccatcaaggttcagtgcagtgatcgngggcagntttcacctcaccatcagcagtctgcaacctgaagactttgctaaacttactactgtcagcagtctacagtacggcggctacgttggacaggggacaagcgtaggagatacgaacgtacgtgtacggctgacacagtctgtcttcacgttcttacccgctatctcgacgacacgcgagcgtgagcggctaggacg

SEQ ID NO: 341563 - DNA, 517 bp, Homo sapiens
  misc_feature: GZ8MTXP02FO5J5.8.67.G01.1.454.CMB.2.raw
  modified_base (253)..(253): a, c, t, g, unknown or other
  misc_feature (253)..(253): n is a, c, g, or t
  modified_base (325)..(325): a, c, t, g, unknown or other
  misc_feature (325)..(325): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaacgcccccaaatcctgatttanggtgcatccatttcgcaaagtggggtcccatcaaggttcagtggcagtggatctggggcagatttcaccctnaccatcagcagtctgcaacctgaacgactttgcaaacttactactgtcagcagtcttacagtacggccggctaccgtttggaccgagggggacaaagcgtagggagatacggaaacgtactggtggactggcaccatctagtcttcacttccttcccgctatctgacacacgcgagctgagcgggctggacg

SEQ ID NO: 341564 - DNA, 501 bp, Homo sapiens
  misc_feature: GZ8MTXP02FSWMH.8.67.G01.1.454.CMB.2.raw
  modified_base (251)..(251): a, c, t, g, unknown or other
  misc_feature (251)..(251): n is a, c, g, or t
  modified_base (490)..(490): a, c, t, g, unknown or other
  misc_feature (490)..(490): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgccccccaaaatcctgatttanggtgcatccatttcgcaaagtgggtcccatcaaggttcagtggcagtggatcgtggggcagtattcaccctcaccatcagcagtctgccaacctgaaagactttagactaaacttctaactgtcagcagtcttacagtagcggcacttgccgagggacagctggagatacgaacgaactgtggctgcaccatctgtcttcactcttccgccatctgagacacgcgagctgacgcggcgnggacgacgcga

SEQ ID NO: 341565 - DNA, 521 bp, Homo sapiens
  misc_feature: GZ8MTXP02I636L.8.67.G01.1.454.CMB.2.raw
  modified_base (511)..(511): a, c, t, g, unknown or other
  misc_feature (511)..(511): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttatggtgcatccatttcgcaaagtggggtcccatcaaggttcagtggcagtggatcgtggggcagatttcaccctcacccatcagcagtctgcccaacctgaagtactttgacctaacttctactgtcagcagtcttacagtaggcccggctaccgtttggccgaggggacgaagcgtgggagagtacgaaacgaactggtgctgacaccatctgtcttcactcttacccgctatctcgacgacacgcgagctgacgcggtcnggcacggcga

SEQ ID NO: 341566 - DNA, 535 bp, Homo sapiens
  misc_feature: GZ8MTXP02JKYGK.8.67.G01.1.454.CMB.2.raw
  modified_base (253)..(253): a, c, t, g, unknown or other
  misc_feature (253)..(253): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaatcctgatttatggtncatccatttcgcaaagtggggtcccatcaaggttcagtggcagtggatcgtggggcagatttcaccctcaccatcagcagtctgacccaacctgaagactttgactaacttctactgtccagctagtcttacagtacggccggctaccgtttggcccgtagggggaccgaaagcgtagggagagtacggaaacgaacgtggtggctggaccaccatctgtcttcactccttcccgcatctgacgacacgcgagcgtggacggcgggctggaccaagggcacg

SEQ ID NO: 341567 - DNA, 580 bp, Homo sapiens
  misc_feature: GZ8MTXP02GG7QB.8.67.G01.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttanggtncatccatttcgcaaagtgggtccatcaaggttcagtggcagtggatcgtggggcagatttcacctcaccatcagcagtctgacccaaccgtgaaagtacttttgacctaaactttcgtacctgttaccagcctaagttcttaacgagtacgggcccgggactaaccgtttggacccgaagggggacaaggcgtagggagacgtacggaaacgtaacgtggtaggactcggaccaaccgattccgttgtaccttcacttccttcccgactactcgtagacgaccacggacgagcgtggacggccggggcgtacggacgacggcgacg

SEQ ID NO: 341568 - DNA, 588 bp, Homo sapiens
  misc_feature: GZ8MTXP02IDKCI.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaccttttttaaattggtatcaacagacgacccaaggaaaacgcccccaaaactcctgatttatggtgcatccatttcgcaaagtgggtcccatcaaggttcagtggcagtgatcgtgggcagtatttcaccctcaccatcagcacgtctcgacaacctgaacgtctttgactaaacttactactgtcagcagtctacagtacggccggctaccgtttggaccgtagggggacgaagcgtagggagtaacgtacggaacgtaacgttcggtaggcctacggacctacccgtaattccgttcgttactttcctaactttcccgttccccgacctactcgttacgaacgtaccgacggcgaacggccgttaggacggccgggcgtacggaaccgg

SEQ ID NO: 341569 - DNA, 573 bp, Homo sapiens
  misc_feature: GZ8MTXP02HCQCC.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggcaagtcagaccattagctacctttttaaatggtatcaacagagcccaggaaaacgccccaaactcctgatttatggtgcatccatttcgacaaagtgggtcccatcaaagtcagtggcagtggatcgtggggcagatttccaccctcaccatcagcacgtctgacaacctgaaacgtactttgacctaaacttactactgtacagcagttcttacagtatggccggactaccgttggaccgaaggggacgaagcgtaggagacgtacgaaacgtagtggtaggctaggaccaaccattccgtgttccttacaccttcccgtttaccccgcctaacttccgtacggaacgaccgaaccggcgaacgtcccgtaggacgggtccggggtcgtacgggg

SEQ ID NO: 341570 - DNA, 528 bp, Homo sapiens
  misc_feature: GZ8MTXP02H9WXG.8.67.G01.1.454.CMB.2.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (517)..(517): a, c, t, g, unknown or other
  misc_feature (517)..(517): n is a, c, g, or t
tcagctcgcgtgtccacgaccggtgctcgatttagagtatacatattgggtttgggggctttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaatcctgatttatggtncatccatttcgnaaagtgggtcccatcaagtcagtggcagtgatcgtgggcagatttcaccctcaccatcagcagtctgacccaacctgaacgtactttgactaactttactactgtacagcagtcttacagtacggccggctaccgtttggccgagggggacgaagcgtagggagagtacgaacgtactggtagctagcacatctcgtcttacacttccgttcccgcctacttctacgacgacacgcgagcgtgacgcggcnggcgacggcag

SEQ ID NO: 341571 - DNA, 527 bp, Homo sapiens
  misc_feature: GZ8MTXP02FPTBF.8.67.G01.1.454.CMB.2.raw
  modified_base (392)..(392): a, c, t, g, unknown or other
  misc_feature (392)..(392): n is a, c, g, or t
  modified_base (458)..(458): a, c, t, g, unknown or other
  misc_feature (458)..(458): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctgatttatggtgcatccatttcgcaaagtcggggtcccatcaaggttcagtggcagtggatcgtggggcagatttccaccctcaccatcagcagtctgacaacctgaagtactttgactaacttactactgtcagcctagtcttanagtacggcccggctaccgttggaccgagggggacgaagcgtagggagacgtacgaacgaacgtggngactgcaccgatctgtcttcacttcctccgcatctcgacgacacgcgagctaggagccgggctggaacg

SEQ ID NO: 341572 - DNA, 602 bp, Homo sapiens
  misc_feature: GZ8MTXP02F0FSC.8.67.G01.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctacctttttaaatggtatcaacagagcccaaggaaaacncccccaaatcctgatttanggtgcatccatttcgactaaaggtcggggtcccatcaaggttcagtggcagtggatcgtggggcagtactttcaccctcaccatcagcacgtctcgacaacctgaacgtactttgactaacttactactgtacagctagtcttacgagtacggccggctaccgttggaccgaaggggacgaagcgtagggacgtactacggaaacgtaacgtgggtacggtactcggaccaaccctaattccgttagttccctttacgtaactttccctttccccgacctacttccgtacgaacgtaccgacggaaccgaacggcgttacgggacgggtccggggcgtacgggaaccg

SEQ ID NO: 341573 - DNA, 525 bp, Homo sapiens
  misc_feature: GZ8MTXP02H7FXP.8.67.G01.1.454.CMB.2.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (322)..(322): a, c, t, g, unknown or other
  misc_feature (322)..(322): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaatcctgattanggtncatccattcgcaaagtgggtcccatcaaaggttcagtggcagtggatcgtggggcagatttcacctnaccatcagcagtctgcaaactgaagactttgactaaacttactacgtgtcagcagtcttacagtaggcggcacgttgcgagggacgagcgagagatacgaacgaanagtgcgngcaccaatctcgtcttactactctttcccctacctactacgtacgacgaacgaccgaacgacgacgtacgacggacggacggtacggacg

SEQ ID NO: 341574 - DNA, 533 bp, Homo sapiens
  misc_feature: GZ8MTXP02I18FT.8.67.G01.1.454.CMB.2.raw
  modified_base (234)..(234): a, c, t, g, unknown or other
  misc_feature (234)..(234): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaactcctgatttatggtgcatccattcgacaaaggtggggtcccatcaaggttcagtggcagtggatcgtggggcagtatttccaccctcaccatcagcagtctgcaacctgaacgtctttgactaactttactactgtacagcagtcttacagtacggccggctacgttcggaccgtaggggacagcgtaggagatacggaacgaacgtggtacgctgacacctatctgtcttcacttccttccgctatctagacgaccgacgcgacgcgtacggacggcgggctacggacg

SEQ ID NO: 341575 - DNA, 521 bp, Homo sapiens
  misc_feature: GZ8MTXP02FMH1U.8.67.G01.1.454.CMB.2.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (445)..(445): a, c, t, g, unknown or other
  misc_feature (445)..(445): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccatttcgcaaagtgggtcccatcaaggttcagtggcagtggatcgtggggcagatttcaccctcaccatcagcagtctgaccaacctgaaagtactttgactaactttcactgtcagcagtcttacagtaggccggctaccgtttggcccgaggggacgaagcgtagggagatacgaaacgactggngctgacaccatctgtcttcatccttcccgcatcctgacgacacgcgagcgtgacggcgggctaggccaagggcacg

SEQ ID NO: 341576 - DNA, 633 bp, Homo sapiens
  misc_feature: GZ8MTXP02JK2T4.8.67.G01.1.454.CMB.2.raw
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaacnccccaaatcctgatttanggtncatccatttcgacaaaggtcggggtacccatcgaaggttcagtggcaggtggatcgtggggcagtactttccaccctcaccatcagcacgtctgacaaccgtgaaacgtactttcgactaaactttactactgtacagctacgttcttaacgaggtacgggccgggtacctacccgtttcgggaccggtaacgggggacgaaacgcgtagggagacgtacggaaacgtaacgtcgggtaggcgtacggacaaccgtactccgttcgttacctttacgtactttccccgtttccccggacctaacgttccgttacggaaccgtaaccgaccggaacggtacggccgtaggggacgggccggggtacggtacggaaccgg

SEQ ID NO: 341577 - DNA, 578 bp, Homo sapiens
  misc_feature: GZ8MTXP02JMN0D.8.67.G01.1.454.CMB.2.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccggcaagtcagaccattagcaccttttaaatggtatcaacagagccaggaaaacncccaaatctnattangncatcattcacaagtcggtccatcaagtcagtgcagtgatcgtggcagtactttccaccctcacatcagcacgtctcgacaacctacgaacgtactttcgtactaaacttaactaactagtacagactacgtacttaacgtaagtacgggaccgggtaccgtaccgtttacggtaccggaacggggaacggaaacgacgtaggaaggaacgtacgtaaacgaaacgtacgtaggcgtcgacaccactactcgttcttactacttccttacccgtacctactacgtacgtacgaacgacgaacgacgacgtacggacggacgggacgtacggacg

SEQ ID NO: 341578 - DNA, 505 bp, Homo sapiens
  misc_feature: GZ8MTXP02FJNMK.8.67.G01.1.454.CMB.2.raw
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaactcctgatttatggtgcatccatttcgacaaaggtggggtcccatcaaggttcagtggcagtggatcgtggggcagatttcaccctcaccatcagcagtctgcaacctgaagactttgacaaacttactactgtcagcagtcttacagtacggccgggctaccgttggccgaagggggacaagcgtaggagatcgaacgactggtgctgcacatcngtctcactctccgcatcngacacacgngagcngacgcggcnggacg

SEQ ID NO: 341579 - DNA, 655 bp, Homo sapiens
  misc_feature: GZ8MTXP02H4M4Y.8.67.G01.1.454.CMB.2.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctactttttaaatggtatcaacagagccaaggaaaacncccccaaatcctagtattatggtncatcctattcgcaaagtcgggtcccatcaaggttcagtgcaggtgatcgtgggcagtattccacctcacatcagcagtctgacccaacgtgaacgtacttttgacttaaacctttactacgttgtacctacgtctacgttacctttaacgaacgggttaaccggggcccgggtaccgttacccggtttacgggacccgggtaacgggggaaccggaaggtaccggttagggacgtaacggtaccggtaaacggtaaacgttggggttacggacgttacggacctaacgtacttcgttacgttccttaccaccgtttcccgtacccccgtctacgttcgacgtacgaccgacgtcgacggtcgtaacgggacggccggggtcgacgggaccgaacgggtccacg

SEQ ID NO: 341580 - DNA, 510 bp, Homo sapiens
  misc_feature: GZ8MTXP02FTEWE.8.67.G01.1.454.CMB.2.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
  modified_base (487)..(487): a, c, t, g, unknown or other
  misc_feature (487)..(487): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcaccttttaaatggtatcaacagagcccaggaaaacncccccaaactcctgatttanggtgcatccatttcgcaaagtgggtcccatcaaggttcagtggcagtggatctggggcagatttcaccctnaacatcagcagtctgcaaacctgaaacgtactttgcctaaacttactactgtacagcagtcttacagtaggccggctaccgttggcgaggggacaagcgtaggagatacgaaacgactggtggcctgccaccatctagtcttcattcctacccgcatctacgacncacgcgagctgagcggctggacg

SEQ ID NO: 341581 - DNA, 534 bp, Homo sapiens
  misc_feature: GZ8MTXP02IKJC3.8.67.G01.1.454.CMB.2.raw
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (331)..(331): a, c, t, g, unknown or other
  misc_feature (331)..(331): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggcaagtcagaccattagctacctttttaaatggtatcaacagagccaggaaacnccccaaatctgatttanggtgcatccattcgcaaagtgggtcccatcaaggttcagtgcagtgatcgtgggcagtatttcaccctcaccatcagctagtcngacaacctgaacgtactttgactaacttactactgtacagcatcttacagtacggcggctacgtttcggacgaggggacgagcgtaggacgagtacgaacgtaacgtggacgctcgactacgacttcgtcgtcttctacgttccttcccgcctactctacgacgtacgacgaacgacgcgtcggacggtccggcgtacggacg

SEQ ID NO: 341582 - DNA, 533 bp, Homo sapiens
  misc_feature: GZ8MTXP02GXDZ7.8.67.G01.1.454.CMB.2.raw
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctacctttttaaatggtatcaacagagcccaaggaaaacncccccaaactcctgatttanggtgcatccatttcgacaaagtggggtcccatcaaggttcagtgcagtggatcgnggggcagtatttcaccctnaccatcagcagtctgcaactgaacgtactttgactaacttactactgtacagcagtcttacgagtacggccggctacgttcggaccgtagggggacagcgtaggagagtcgaacgacgtggtagctgactacgatcctgtcttcacttccgttacccgctagtctacgacgtacacgcgacgcgtaggacgcgggcgtaggacg

SEQ ID NO: 341583 - DNA, 532 bp, Homo sapiens
  misc_feature: GZ8MTXP02GOV2P.8.67.G01.1.454.CMB.2.raw
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgccccccaaatcctgatttatggtncatccatttcgcaaagtggggtcccatcaaggttcagtggcagtggatcgtggggcagatttcaccctcaccatcagcagtctgacccaacctgaagactttgacctaacttctactgtacagctagtcttacagtaggccggcaccgtttggcccgaggggacgaagcgtaggagagtacgaacgaacgtggtaggctgacacctagtctcgtctctatccttcccgctatctacgacgacacgcgagcgtgacggcgggtcgcggacgacggcgcg

SEQ ID NO: 341584 - DNA, 541 bp, Homo sapiens
  misc_feature: GZ8MTXP02F9248.8.67.G01.1.454.CMB.2.raw
  modified_base (462)..(462): a, c, t, g, unknown or other
  misc_feature (462)..(462): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatccctccctgtctgctttctataggagacagagtcaccatcacttggccgggcaagtcagaccattagctactttttaaatggtatcaacagagcccaaggaaaacgcccccaaatcctgatttagtggtgcatccatttcgacaaaggtcggggtcccatcaaggttcagtggcagtggatcgtggggcagtatttcaccctcaccatcagcagtctgacaacctgaaagtactttgactaaacttactactgtacagctagtcttaacagtacggccggctaccgttggaccgaggggacgaagcgtagggagagtacgaacgacgtaggngactgacacatctagtctcacttccttacccgctatcgtagacgacaacgcgaacgctaggacggcgggcgtcggaacg

SEQ ID NO: 341585 - DNA, 524 bp, Homo sapiens
  misc_feature: GZ8MTXP02HYC79.8.67.G01.1.454.CMB.2.raw
  modified_base (390)..(390): a, c, t, g, unknown or other
  misc_feature (390)..(390): n is a, c, g, or t
  modified_base (447)..(447): a, c, t, g, unknown or other
  misc_feature (447)..(447): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaatcctgatttatggtgcatccatttcgacaaagtcgggtcccatcaaggttcagtggcagtgatcgtggggcagatttcaccctcaccatcagcacgtctgcaaccgtgaacgtactttgactaaacttactactgtcagctagtcttanagtacggccggctaccgtttggaccgaggggacgagcgtggagatcgaacgactggngctgcacgatctagtcttacacttccttcccgctagtctcgacgacgacgcgacgcgtgacggtcggacgtcggacg

SEQ ID NO: 341586 - DNA, 556 bp, Homo sapiens
  misc_feature: GZ8MTXP02HZ5L6.8.67.G01.1.454.CMB.2.raw
  modified_base (178)..(178): a, c, t, g, unknown or other
  misc_feature (178)..(178): n is a, c, g, or t
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
  modified_base (456)..(456): a, c, t, g, unknown or other
  misc_feature (456)..(456): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggnaagtcagaccattagctaacctttttaaatggtatcaacagagcccaaggaaaacncccccaaatcctgatttanggtgcatccattcgacaaagtcgggtcccatcaaggtcagtggcagtgatcgtgggcagtntttcacctnacatcagcacgtctagcaacctgaagtaccttttgacctaaacttacgtacttgccagccatactanagtacggccggctaccgttggccgaaggggacctaagcgtaggaagagtacggaacgtaacgtggngacgtcgactaccgatcgtagtccttactactccgtttcccgactactcctagacgaccgaacggcgaacgccgtaggacggaccgggcgtacggaccgg

SEQ ID NO: 341587 - DNA, 576 bp, Homo sapiens
  misc_feature: GZ8MTXP02G9IMA.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgcccaaggaaaacgcccccaaactcctagtatttatggtgcatccatttcgacaaaggtcgggtcccatcaaggttcagtgcagtgatcgtgggcagtactttccaccctcaccatcagcacgtctgaccaactgaacgtcttgactaacttactactgtacagctacgttctacgaggtacgggccggtacctaccgttcgggaccgtaaggggacgaagcgtagggacgtacgtacggaacgtacgtggtacggactcgacctacctattccgtacgttccttacgtacttcccgttcccgactactcgtacgaccgaccgacgcgacgtcgtcggacggcggtcgaggacgg

SEQ ID NO: 341588 - DNA, 616 bp, Homo sapiens
  misc_feature: GZ8MTXP02H55UP.8.67.G01.1.454.CMB.2.raw
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccggcaagtcagaccattagctaaccttttttaaatggtatcaacagacgacccaaggaaaacgcccccaaactcctagatttanggtncatcctatttcgacaaaggtcgggtcccatacgtaaggttcagtggcaggtggatcgtggggcagtactttcaccctcaccatcagcagtctcgacaactgaacgtactttgactaacttacctactgtacagtctacgtcttaacgagtacgggtcccggcttaccggtttacgggaccgtaacgggggaccgtaaggtcgtacgggaagtacgttacggaaacgtaacggtgggttcggacgtacggacctaaccgtcgttcgtacgttcctttactccttacccttccccgacttactacgtacgaacgaccgacgcggacgacgtcggacggtccgggcgtacggacgg

SEQ ID NO: 341589 - DNA, 525 bp, Homo sapiens
  misc_feature: GZ8MTXP02JSZ46.8.67.G01.1.454.CMB.2.raw
  modified_base (179)..(179): a, c, t, g, unknown or other
  misc_feature (179)..(179): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggnaagtcagaccattagctacctttttaaatggtatcaacagagcccaaggaaaacncccccaaatcctagatttanggtgcatccattcgcaaagtgggtcccatcaaggttcagtggcagtggatctggggcagtatttcaccctnaccatcagcagtctgcaacctgaagactttgactaacttactactgtcagcagtcttacagtacggccggctaccttcggccgagggggaccaagcgtaggacgagtacgaacgacgtggtcgctgacaccatctgtccttcacttccttcccgctatctacgacgacacgaacgacgctcggaggccggtcgtcggacg

SEQ ID NO: 341590 - DNA, 506 bp, Homo sapiens
  misc_feature: GZ8MTXP02F9ZFZ.8.67.G01.1.454.CMB.2.raw
  modified_base (483)..(483): a, c, t, g, unknown or other
  misc_feature (483)..(483): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacgccccaaactcctgatttatggtgcatccatttcgcaaagtggggtcccatcaaggttcagtggcagtggatctggggcagatttcaccctcaccatcagcagtctgcaacctgaagtctttgcaaacttactactgtcagcagtcttacagtacggccgggcacctttgggccgagggggaccaagctagggagatcggaaacgactggtggctgcacctatctgtcttcactccttcccgcatctgacnacgcgagctgagtcggctggacg

SEQ ID NO: 341591 - DNA, 574 bp, Homo sapiens
  misc_feature: GZ8MTXP02H3O8S.8.67.G01.1.454.CMB.2.raw
  modified_base (336)..(336): a, c, t, g, unknown or other
  misc_feature (336)..(336): n is a, c, g, or t
  modified_base (471)..(471): a, c, t, g, unknown or other
  misc_feature (471)..(471): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatcctccctgtctgcttctataggagacagagtcaccatcacttgccgggcaagtcagaccattagctaccttttttaaatggtatcaacagacgacccaaggaaaacgcccccaaactcctagtatttatggtgcatccatttcgacaaaggtcggggtcccatcaaggttcagtggcaggtggatcgtggggcagtatttcaccctnaccatcagcagtctcgacaacctgaagtactttgacctaaactttacctatcgtcagtcagtcttacaggtacggccgggctaccgtttggaccgaggggacgaagcgtaggagacgtacggaaacgacgttggnggactgacctaccgattccgtgttcttacgtacttcccgttacccgctacgtccgtagacgaaccgacgcgacgtcgtacggacggccgggtcgtacggaccg

SEQ ID NO: 341592 - DNA, 529 bp, Homo sapiens
  misc_feature: GZ8MTXP02HB9XZ.8.67.G01.1.454.CMB.2.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (319)..(319): a, c, t, g, unknown or other
  misc_feature (319)..(319): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctcctgtctgcttctataggagacagagtcaccatcacttgccggcaagtcagaccattagctactttttaaatgtatcaacagagaccaaggaaaacgccccaaatcctgtatttanggtncatccattcgacaaaggtgggtcccatcaaggttcagtgcagtgatcgtgggcagatttcaccctnaccatcagcagtctgcaaactgaactactttgactaacttactactgtacagtctagtcttagagtcggccggactaccgtttggaccgaaggggacgagcgtaggacgagtacggaaacgtaagtggtaggctagaccaactactctcgtcttacacttccttcccacagtactacacgcgagcgtaggacgcgggctggacaaggccg

SEQ ID NO: 341593 - DNA, 548 bp, Homo sapiens
  misc_feature: GZ8MTXP02HC99R.8.67.G01.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgccccccaaatcctgtatttanggtncatccatttcgcaaagtgggtcccatcaaggttcagtggcagtggatcgtggggcagactttcaccctcacccatcagcagtctgcccaactgaagtactttgactaacttctactgtcagtcaagtcttaacagtacggccggctaccgttggacccgaggggtacgaagcgtaggagagtacgaacgtacgtgtgctgcaccattctgttcttacacgttccttcccgcctagtctacgacgaccacgcgacgcgtaacggcggccggggctcggacgaacggggcacg

SEQ ID NO: 341594 - DNA, 503 bp, Homo sapiens
  misc_feature: GZ8MTXP02JNWQ4.8.67.G01.1.454.CMB.2.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (320)..(320): a, c, t, g, unknown or other
  misc_feature (320)..(320): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgcccccaaatcctgatttanggtncatccatttcgcaaagtgggtcccatcaaggttcagtggcagtggatcgtgggcagatttcaccctnaccatcagcagtctgaccaacctgaagactttgacaacttctactgtcagcagtcttacagtagccggcaccgtttggccgaggggacgaagcgtggagagtacgaacgaacgtgtagctgcacgatctgtcttcatctcccgcatctcgagacacgcgagctgacggcggctggcgaggcga

SEQ ID NO: 341595 - DNA, 573 bp, Homo sapiens
  misc_feature: GZ8MTXP02H9A8L.8.67.G01.1.454.CMB.2.raw
  modified_base (179)..(179): a, c, t, g, unknown or other
  misc_feature (179)..(179): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccggnaagtcagaccattagctaaccttttaaatggtatcaacagacgacccaaggaaaacncccccaaatcctagatttanggtgcatccattcgacaaagtcggggtccatcaaggttcagtgcagtggatcgtggggcagatttcaccctcaaacatcagcagtctgacaacctgaagtactttgaccttaaacttacctactgtacagtccagttctacgaggtacggcccggctaccgtttgggccgagggggtacgagcgtagggagtaacgtacggaaacgagtaggtggcgtacgacaccctattccgtgttcctactacttccctttcccggacctactcgtacgaacnccgaacgcggacgtccgnggacggtcgggcgtacggaccgg

SEQ ID NO: 341596 - DNA, 534 bp, Homo sapiens
  misc_feature: GZ8MTXP02FV5GE.8.67.G01.1.454.CMB.2.raw
  modified_base (402)..(402): a, c, t, g, unknown or other
  misc_feature (402)..(402): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctagattttatggtgcatccatttcgacaaagtgggtcccatcaaggttcagtggcagtggatcgtggggcagatttcaccctcaccatcagcagtctgcaacctgaaacgtctttgactaaacttactactgtcagcagtcttacagtaggccggntaccttggcgaggggacagcgtaggagatcggaaacgactggtcggctgaccgacctagttcctgttccttcgacttccttacccgcctactctacgacgaccacgcgacgcgtcggaggcggcgtcggacg

SEQ ID NO: 341597 - DNA, 529 bp, Homo sapiens
  misc_feature: GZ8MTXP02H6XLK.8.67.G01.1.454.CMB.2.raw
  modified_base (180)..(180): a, c, t, g, unknown or other
  misc_feature (180)..(180): n is a, c, g, or t
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
tcagctcgcgtgtccacgaccggtgctcgatttagagtatacatattgggtttggggctcagctcctgggggctcctgctactctggctccgaggtgccagatgtgacatccagatgacccagtctccatcctccctgtctgctttctataggagacagagtcaccatcacttgccgggnaagtcagaccattagctaacctttttaaatggtaatcaacagagcccaaggaaaacgcccccaaaatcctgatttanggtgcatcattcgacaaagtcggggtccatcaaggttcagtgcagtggatcgtgggcagatttcacctnacatcagcagctagcaactgaanctttnactaactactagtncganacacgtactagtagtacggacggcgtacgttacggacggacgggacggagacgagagagtacgaacgagtagtgcgacgacacactctgtctactactactacctcctactactacgacgacgacgaacgacgacgacgaggcggacggtacggacg

SEQ ID NO: 341598 - DNA, 536 bp, Homo sapiens
  misc_feature: GZ8MTXP02GSPJW.8.67.G01.1.454.CMB.2.raw
  modified_base (261)..(261): a, c, t, g, unknown or other
  misc_feature (261)..(261): n is a, c, g, or t
  modified_base (445)..(445): a, c, t, g, unknown or other
  misc_feature (445)..(445): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctaaccttttttaaatggtatcaacagagacccaaggaaaacgcccccaaatcctgatttatggtncatccatttcgacaaaggtcggggtacccatcgaaggttcaggtggcaggtggatcgtggggcagtatttccaccctcaccatcagcagtctgacaactgaagtactttgactaacttactactgtacagctagtcttagagtacggccggctaccgttggcgaagggggacgagcgtaggganacgtacgaaacgacgtggtcggactgacctactatctgtctctactcctccgactatcagacacacgcgacgcgtaggacgcggctggacg

SEQ ID NO: 341599 - DNA, 520 bp, Homo sapiens
  misc_feature: GZ8MTXP02IZJAS.8.67.G01.1.454.CMB.2.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (492)..(492): a, c, t, g, unknown or other
  misc_feature (492)..(492): n is a, c, g, or t
tcagctcgcgtgtccacgaccggtgctcgatttagagtatacatattgggtttggggctcagctcccggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtgcatccattcgcaaagtgggtcccatcaagttcagtgcagtggatcgtggggcagatttcaccctnaccatcagcagtcctgcaactgaagactttgctaaacttactactgtcagctagtcttacagtacggccgggactaccgtttggccgaagggggacaaagcgtaggagactacgaaacgaactggtggactgcaccatcgtgtcttcattccttaccgccatctgacgacncgcgaagcgtgacgcggactggacaagg

SEQ ID NO: 341600 - DNA, 522 bp, Homo sapiens
  misc_feature: GZ8MTXP02FSSN6.8.67.G01.1.454.CMB.2.raw
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagctcgcgtgtccacgaccggtgctcgatttagagtatacatattgggtttggggctcagctcctggggctcctgctactctggctccgaggtgccagatgtgacatccagatgacccagtctccatccctccctgtctgcttctataggagacagagtcaccatcacttggccgggcaagtcagaccattagctaactttttaaatggtatcaacagacgcccaaggaaaacncccccaaatcctagtatttagnggtgcatccatttcgacaaaggtggggtcccatcaaggttcagtggcagtggatcgtggggcagtatttccaccctcaccatcaagcagtctgacaacctgaaagtactttgactaacttactactgtcagcagtctanagtagccggntacgttggccgaggggacaagcgtaggagatacgaagactggtggactgacaccgatctgtctcactcttccgcctatctagacgaccacggcgtagctaggcgcgggctggacg

SEQ ID NO: 341601 - DNA, 587 bp, Homo sapiens
  misc_feature: GZ8MTXP02GMO6I.8.67.G01.1.454.CMB.2.raw
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (542)..(542): a, c, t, g, unknown or other
  misc_feature (542)..(542): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgacccaaggaaaacccnccccaaactcctagtatttagtggtnacatcctatttcgacgtaaaggtcgggtacccagtacgtaaggttcaggtggctaggtggatcggtggggacagtactttcccaccctcaaccatcagctacgtctacgactaaccgtagtaacgttactttcgaacctaaacttactacttgtacacgtactacgttacttacgacggtacgggccggtaccgtacgttacggaccggaggggacgagacgtaggagagtacggaacgtagtggtagcgcgacactctctcgtctactactcctccnctactcgacgacgacgacgcgcgcgtacggcgcggacgtcggacg

SEQ ID NO: 341602 - DNA, 534 bp, Homo sapiens
  misc_feature: GZ8MTXP02IVVFI.8.67.G01.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacngagcccaaggaaacnccccaaactcctgatttanggtncatccatttcgacaaagtcgggtcccatcaaggttcagtgcagtgatcgtggggcagtactttccaccctcaccatcagcagtctgcaacctgaactacttgacctaacttactactgtacagctagttcttacgagtacggccggctaccgtttggaccgaggggacagcgtaggagacgtacgaacgacgtggtacggctcggacaccattctgtctctactccttcccgctatcgtacgaacgacgacgcgacgacgtcggacgcggctcggacg

SEQ ID NO: 341603 - DNA, 565 bp, Homo sapiens
  misc_feature: GZ8MTXP02GYM1F.8.67.G01.1.454.CMB.2.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (336)..(336): a, c, t, g, unknown or other
  misc_feature (336)..(336): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacncccccaaatcctgatttagnggtgcatccatttcgactaaaggtcgggtacccatacgaaggttcagtggctaggtggatcgtggggcagtactttccacctnaccatcagcacgtctgacaaccgtgaacgtactttgactaaacttactactgtacagactagttcttaacgagtacgggccggctacgttcggaccgtaggggacaggcgtaggagtacgtacggaaacgtacgtggtcggactcgaccactactcgtcgttctacgtcttcccgtccgacctagtcgtcgaacgacgagcgagtcgtggacgcgggtaccgacggacg

SEQ ID NO: 341604 - DNA, 542 bp, Homo sapiens
  misc_feature: GZ8MTXP02GUT1F.8.67.G01.1.454.CMB.2.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaggaaaacnccccaaatcctgatttanggtncatccatttcgcaaagtgggtcccatcaaggttcagtgcagtggatcgtgggcagtatttcaccctcaccatcagcagtctgaccaacctgaacgtactttgacctaacttctactgtcagcagtcttacagtagccggctaccgttggccgaggggacgaagcgtaggagacgtacgaaacgacgtggtaggctggaccaccgtagtctgtacttctacgtccttacccgcctatccgtacgacgaccacgcgaacgcgtaagacggcgggactggacgaacggcgacg

SEQ ID NO: 341605 - DNA, 580 bp, Homo sapiens
  misc_feature: GZ8MTXP02GBOI8.8.67.G01.1.454.CMB.2.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatggtatcaacagagacccaaggaaaacnccccaaactcctgatttanggtgcatcatttcgacaaaggtcggggtcccatcaaggttcagtggcaggtggatcgtggggcagtactttccaccctcaccatcagcagtctgacaacctgaacgtactttgactaaacttactactgtacagctagtacttacgagtacgggccgggtctaccgttgggaccgaagggggacgaacgcgtagggaagacgtacggaaacggacttgggaggctgacacctagtctagtcttcactttcccgtcccgactacttcgtacgaacgtaccgacggaaccgtaggcgtacgggacggccggggtacgtacgggaacgg

SEQ ID NO: 341606 - DNA, 593 bp, Homo sapiens
  misc_feature: GZ8MTXP02IC7QV.8.67.G01.1.454.CMB.2.raw
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatccctccctgtctgcttctataggagacagagtcaccatcacttgccgggcaagtcagaccattagctaaccttttttaaattggtatcaacagacgacccaaggaaaacncccccaaactcctagtatttagtggtncatcctatttcgacaaaggtcgggtcccatcgaaggttcagtggcagtgatcgtgggcagtactttccaccctcaccatcagcacgtctgaccaaccgtgaaacgttactttgaccttaaactttacctacttgtacagctacgttctaacgtaggtacgggcccggtctacgttcggaccgtaggggacgagcgtaggacgtagtaccgaagtactggtcgcgtacgacctacctattcgtacgttcttctacgttcccgttcccgactactcgtacgacgaaccgcggaacgacgtcgtaggcgggtccggtacgcgggaaccg

SEQ ID NO: 341607 - DNA, 624 bp, Homo sapiens
  misc_feature: GZ8MTXP02GEZ2S.8.67.G01.1.454.CMB.2.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctcctgtctgcttctataggagacagagtcaccatcacttggccggcaagtcagaccattagctacctttttaaatggtancaacagacncccaaggaaacnccccaaatccngatttanggtgcatccatttcgacaaaggtgggtcccatcgaagttcagtggcagtgatcgtggggcagattccacctnaaccatanagcagtctagacaacctgaacgtctttgacctaaacttactaactgtacagctagtcttacagtacgcccggctaccgttcgaccgaaggggacaaagcgtaggaacgaacgtacggaaacgaacgttggacggaccgttacggacctaacccgtaatttccgtacggtttccgtaccttaacgttccccggtttaccccgacccttaaagttcccgttggtaaaacgtacccgaacgggttaaccgaaccggtccgttagggaacggcccgggtacggttcggaacccggg

SEQ ID NO: 341608 - DNA, 616 bp, Homo sapiens
  misc_feature: GZ8MTXP02HZ3XQ.8.67.G01.1.454.CMB.2.raw
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagacgacccaaggaaaacgcccccaaatcctagatttanggtncatcctatttcgacaaaggtcggggtacccatcgaaaggttcagtggcaggtggatcgtggggcagtactttccaccctcaccatcagcagtctgacaacctgaaacgtctttgactaaactttacactgtacagtctagtcttaacgaggtacgggccggactaccgtttcggaccgtaagggggaacagcgtagggacgaacgtacggaaacgtaacgtgggtacggactcggaacctaccgtaattccgttacgtacctttcgtaacttccccgtttaccccggactacttacgtcgaaacgtaaccgaccggaacggacgtacgtcggacggccggggtacgtacgggaccg

SEQ ID NO: 341609 - DNA, 536 bp, Homo sapiens
  misc_feature: GZ8MTXP02JNWSY.8.67.G01.1.454.CMB.2.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaccttttttaaatggtatcaacagagcccaaggaaaacgcccccaaatcctgatttanggtgcatccattcgcaaaggtggggtcccatcaaggttcagtggcagtggatcgtggggcagtatttccaccctcaccatccagcacgtctgactaactgaatactttgacctaacttactactntcagctagtcttacagtacggcgggctacgttcggcgagggggacgaagcgtggagatcgaacgactgtggcngccactntctgtctctactccttcccgacctataccgtgaaccgactacggcgaacgtcgtcggacggtcgggtcgtcggaacg

SEQ ID NO: 341610 - DNA, 603 bp, Homo sapiens
  misc_feature: GZ8MTXP02GUTWQ.8.67.G01.1.454.CMB.2.raw
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (335)..(335): a, c, t, g, unknown or other
  misc_feature (335)..(335): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctccctgtctgcttctataggagacagagtcaccatcacttggccgggcaagtcagaccattagctaacctttttaaatggtatcaacagacgcccaaggaaaacncccccaaatcctgtatttatggtncatccatttcgcaaaggtcggggtcccatcgaaggttcagtggcagtgatcgtggggcagtatttccaccctnaccatcagcacgtctgacaacctgaaacgtctttgactaaacttactactgtcagctagtcttagaggtacggcggtactacgttcggacgaggggacgagcgtaggacgtagtacggaacgtaacgttggtacggacttaggacctacgtaacttccgttcggtttccttacttaccgtttcccgttacccccgtacgtaacttccgtaacggaacgtacccgacggaaccgagtacccgtgggacgaccggggtcgacggaaccgg

SEQ ID NO: 341611 - DNA, 568 bp, Homo sapiens
  misc_feature: GZ8MTXP02IR8HM.8.67.G01.1.454.CMB.2.raw
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatccctccctgtctgctttctataggagacagagtcaccatcacttgccgggacaagtcagaccattagctacctttttaaatggtatcaacagacgacccaaggaaaccnccccaaactctagtatttagnggtncatccatttcgactaaaggtcggggtaccccatacgaaggttcaggtggacaggtggatcgtggggcagtctttccaccctacncacncacgcactctacacactagtagtacttctactacttactactatacacactacgtacgtacgtacgtacggccggtcgtacgtacggacggacgggacgacgacgtaggagacgtacgacgacgtaggtagtcgacactactctcgtactactactcctccactactcgtacgacgacgacgacgaacgcgtacggcggacggcggacggacgacg

SEQ ID NO: 341612 - DNA, 616 bp, Homo sapiens
  misc_feature: GZ8MTXP02I9YLI.8.67.G01.1.454.CMB.2.raw
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (322)..(322): a, c, t, g, unknown or other
  misc_feature (322)..(322): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaaccnccccaaactctagtatttagnggtncatcctattcgacgtaaaggtcgggtacccatacgtaaggttcaggtggctaggtgatcggnggggactagtactttcccaccctacaacctataccgagtcctacgtctacgacctaaccgtagaaacgttctttgacctaaacttactacgtgtacagctacgttacttacgaggtacgggccggtactaccgttcggacgaggggacagtcgtaggagtacgtacgaacgtacgtggtagctacgaccacgtacttcgtacgtcttactacgttcccgttacccgactacgttaccgtacgaacgaccgacggcgacggtacgtacgggacggtccggggtacgtacggaacg

SEQ ID NO: 341613 - DNA, 530 bp, Homo sapiens
  misc_feature: GZ8MTXP02JEO6C.8.67.G01.1.454.CMB.2.raw
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaactcctagatttagtggtgcatccatttcgacaaaggtcgggtcccatcgaaggttcagtggcaggtggatcgtggggcagtatttccaccctnaccatcagcagtcngcaacctgaaagctttgactaactttacgtacctgtcagctacgttctagacgtaggcccggctaccgttggccgaggggacgaagcgtagggagatacggaagacgtggtggctgcacgatcgtntctacncttccttcccgcattcagacaccagcgtagcgcggcggcggcgacggcg

SEQ ID NO: 341614 - DNA, 568 bp, Homo sapiens
  misc_feature: GZ8MTXP02FZ7GA.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaacctttttaaatggtatcaacagacgacccaaggaaaaccgcccccaaaactcctagtatttatggtgcatcctatttcgacaaaggtcgggtcccatcaaggttcagtggcagtgatcgtggggcagtatttccaccctcaccatcagcagtctgacaacctgaagtctttgactaacttactacgtgtcagtctagttcttacgagtacggccggctaccgttggaccgaggggacgaagcgtagggacgtaagtacgaacgtaacgtgggtcgccgtggaccacgtacgttctcgttcttcgtacttcccgttcccgctacttcgtacgacgaccgacgcgacgcgtacggacggcggtcgacggacg

SEQ ID NO: 341615 - DNA, 545 bp, Homo sapiens
  misc_feature: GZ8MTXP02F2HFB.8.67.G01.1.454.CMB.2.raw
  modified_base (250)..(250): a, c, t, g, unknown or other
  misc_feature (250)..(250): n is a, c, g, or t
  modified_base (521)..(521): a, c, t, g, unknown or other
  misc_feature (521)..(521): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaatggtatcaacagagcccaaggaaaacgccccccaaatcctgatttanggtgcatccatttcgcaaagtgggtcccatcaaggttcagtggcagtggatcgtggggcagtatttcaccctcaccatcagcagtctgcccaacctgaagtctttgctaaacttctactgtacagctagttcttacgaggtacgggcccggtctaccgtttggacccgtagggggaccgaaggcgtagggagatacggaaacgaacgtggtcggctaggccaaccgatctgtcttcacgtccttcccgctatctcgacgacacgcgagtcnggacggcggcgtggacacgggcag

SEQ ID NO: 341616 - DNA, 550 bp, Homo sapiens
  misc_feature: GZ8MTXP02GOWD7.8.67.G01.1.454.CMB.2.raw
  modified_base (234)..(234): a, c, t, g, unknown or other
  misc_feature (234)..(234): n is a, c, g, or t
  modified_base (327)..(327): a, c, t, g, unknown or other
  misc_feature (327)..(327): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaatcctgatttatggtgcatccatttcgacaaaggtgggtcccatcaaggttcagtggcagtggatcgtggggcagatttcaccctnaccatcagcagtctgacaacctgaagtactttgactaaacttactactgtacagccagtcttacgagtacgggccggactaccgtttggaccgagggggacagcgtaggagatacgaacgaactggtagctgcaccatctgtcttacacttccgttcccactactccgtaggaacgaccgaacggcgacgtccgttaggacggtcggggacgtcgggaaccgg

SEQ ID NO: 341617 - DNA, 552 bp, Homo sapiens
  misc_feature: GZ8MTXP02HNXNZ.8.67.G01.1.454.CMB.2.raw
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatggtatcaacagagacccaaggaaacgcccccaaactcctagatttagnggtgcatccattcgacaaaggtcgggtcccatcaaggttcagtggcagtgatcgtggggcagatttcaccctnacatcagcagtctagccaactgaatctttgacctaaacttactactgtcagcagtctacgagtacggccggtctaccgttcggacgtagggggacgaagcgtaggacgtagtacgaacgtaacgtggtcggctcggactacgtattctcgtcttaccacgttcctacccgactactacgtacgacgacgacgaacgacgcgtacggacggcggcgtacggacg

SEQ ID NO: 341618 - DNA, 507 bp, Homo sapiens
  misc_feature: GZ8MTXP02JJROL.8.67.G01.1.454.CMB.2.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (492)..(492): a, c, t, g, unknown or other
  misc_feature (492)..(492): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaactcctgatttatggtncatccatttcgacaaaggtgggtcccatcgaaggttcagtggcagtggatcgtggggcagactttccaccctcaccatcagcagtctgcaacngaagtacttgctaacttaactactagtcagcagtcttanagtaggcggcgtacttggcgagggacgagctggagatacgacgaacngtgctcgcacatntcgtntctatccttccgcccatctanacgcaacgcgagtcgngagacggcggacgcg

SEQ ID NO: 341619 - DNA, 614 bp, Homo sapiens
  misc_feature: GZ8MTXP02JEFWO.8.67.G01.1.454.CMB.2.raw
  modified_base (257)..(257): a, c, t, g, unknown or other
  misc_feature (257)..(257): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctactttttaaatgtatcaacagacgacccaaggaaaaccgcccccaaatcctagtatttagnggtgcatcctatttcgactaaaggtcgggtacccatacgaaggttcagtggctaggtcggatcgtggggactaggtactttcccgaccctcacctatcgagcctagtcctagctaaaccgtgaaacgtctttgacctaaactttactactgtacagtcagtcttacgaggtacgggccggtactacgttcgggacgtaacgggggacaaggtcgtaggacgacgtacggaacgtaccgtgggtacgctgaccacgtattccgttacgttccttactaccttcccgtttaccccgacgtaacttccgacgacgacccgacgcggacgacggtcggacggccgggtcgtacggaaccgg

SEQ ID NO: 341620 - DNA, 544 bp, Homo sapiens
  misc_feature: GZ8MTXP02F9BHV.8.67.G01.1.454.CMB.2.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatggtatcaacagagcccaaggaaaacncccccaaatcctgatttanggtgcatccatttcgacaaaggtgggtcccatcaaggttcagtggcaggtggatcgtggggcagtactttcaccctcaccatcagcacgtctcgacaacctgaactactttcgactaaacttactacgtgtacagctagtcttaacgaggtacggccggtactacgttcggaccgaggggacaagcgtaggacgagtacgaacgacgtggtgctcgacacgagtctgtacttcacttccgtcccgctactctcgaacgacacgcgacgcgtaggacggcggcgtacggacg

SEQ ID NO: 341621 - DNA, 618 bp, Homo sapiens
  misc_feature: GZ8MTXP02G72BV.8.67.G01.1.454.CMB.2.raw
  modified_base (180)..(180): a, c, t, g, unknown or other
  misc_feature (180)..(180): n is a, c, g, or t
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggnaagtcagaccattagctacctttttaaatgtatcaacagagaccaaggaaaacgcccccaaactcctagtatttatggtncatccatttcgacaaaggtcggggtcccatacaaggttcagtggcaggtgatcgtgggcagtatttcaccctnaccatcagcagtctgacaactgaagtactttcgactaaacttactactggtacagctaagttcttaacgacggtacgggcccggtactaccgtttgggaccgtaagggggaaccgtaagcgttagggagtaacgtaccggaaagaccgtgggtacggactcggaacctaccagttcctacgttcttacctactttcccgttcccgacctaacttccgtaggaaaccgaccgaccggaacgtaacgggcggaccggggaccgggtcgtacggggacgaaaccgggg

SEQ ID NO: 341622 - DNA, 540 bp, Homo sapiens
  misc_feature: GZ8MTXP02GFTJ8.8.67.G01.1.454.CMB.2.raw
  modified_base (252)..(252): a, c, t, g, unknown or other
  misc_feature (252)..(252): n is a, c, g, or t
  modified_base (326)..(326): a, c, t, g, unknown or other
  misc_feature (326)..(326): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccatagaaaacgccccaaatcctgatttanggtgcatccatttcgacaaagtgggtacccatcaaggttcagtgcagtggatcgtggggcagtatttcaccctnaccatcagccagtctgaccaacctgaagtctttgactaaacttactactgtcagcagtcttacgagtacggccggtacaccgttcggccgtaggggacgaagcgtggacgagtaccgaagaacgtgtacgctgacacctagtctcgttaccttctacttccttccgacctatccgtagacgacaacgcgacgtcgtaggacggcggtcgacggg

SEQ ID NO: 341623 - DNA, 492 bp, Homo sapiens
  misc_feature: GZ8MTXP02IGOMK.8.67.G01.1.454.CMB.2.raw
  modified_base (253)..(253): a, c, t, g, unknown or other
  misc_feature (253)..(253): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttatggtncatccatttcgcaaagtgggtccatcaaggttcagtggcagtggatcgtggggcagatttcaccctcaccatcagcagtctgaccaaacctgaagtactttgacctaacttactactgtccagccagtcttacagtagccggcacttggccaggggacagctggagatcgaacgactgtgctgcacatctgtctnatctccncatcnagacacgcganctgacgcggctggcaaggcag

SEQ ID NO: 341624 - DNA, 525 bp, Homo sapiens
  misc_feature: GZ8MTXP02H33E2.8.67.G01.1.454.CMB.2.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (499)..(499): a, c, t, g, unknown or other
  misc_feature (499)..(499): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaaggaaaacgcccccaaatcctgatttanggtgcatccatttcgcaaagtcgggtccatcaaggttcagtggcaggtgatcgtggggcagatttccaccctcaccatcagcagtcngaccaactnaagctttgcaaacttactactgtacagctagtcttacagtaggccgggctacgtttggcgagggggacaagcgtaggagagtacgaagacttggagctgccacgtatccttgtacttcacttccttccgactagtctgacgacaccggngcgcgtacggacggcggcgtcggacg

SEQ ID NO: 341625 - DNA, 687 bp, Homo sapiens
  misc_feature: GZ8MTXP02G9XAI.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctactttttaaatggtatcaacagacgaccaaggaaaaccgcccccaaactcctagtatttatggtgcatcctatttcgacaaaggtcgggtacccagtcgaaggttcaggtggctaggtggatcggtggggctagtactttccaccctcaccatcagctacgtctagaccaaccgttgaaacgttactttcgaccttaaacttactactcgtacacgtactagttaccttacgacgggtacgggacccggtacctaccgtttcgggaccggtaagggggaccgaaacggtcgtagggaacggtaacgtaaccggtaaacgtaaccgttgggtacggtaccgttacggacccctaaccgtaacgttccgttacggttaccctttccgtaacctttcccccgttaccccgaccttaacgttcgtacggaaccggaaccgaccggcggtacggtacccggtagggaccgggccggggtcggtacgggaacccgg

SEQ ID NO: 341626 - DNA, 583 bp, Homo sapiens
  misc_feature: GZ8MTXP02I30QD.8.67.G01.1.454.CMB.2.raw
  modified_base (264)..(264): a, c, t, g, unknown or other
  misc_feature (264)..(264): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctaacctttttaaatggtatcaacagacgacccaaggaaaacgcccccaaactcctgtatttagtggtncatcctatttcgacaaagtcggggtcccatcgaaggttcagtggcagtggatcgtggggcagtctttacccaccctcacctatcagcacgtctgacaactgaactactttcgactaaacttactactgtacagtctagtcttaacgaggtcggccgtctaccgttcggaccgtaggggaacgtagcgtaggaagacgtacggaacgaagtcgggtggacctggaccactatcttacgttcttactcctccgttcccgactaactcgtacgacgtaccgaacggccgagacgtacgggcgggaccggtcggcggaaccgg

SEQ ID NO: 341627 - DNA, 654 bp, Homo sapiens
  misc_feature: GZ8MTXP02GUXDL.8.67.G01.1.454.CMB.2.raw
  modified_base (269)..(269): a, c, t, g, unknown or other
  misc_feature (269)..(269): n is a, c, g, or t
  modified_base (355)..(355): a, c, t, g, unknown or other
  misc_feature (355)..(355): n is a, c, g, or t
  modified_base (555)..(555): a, c, t, g, unknown or other
  misc_feature (555)..(555): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggacaagtcagaccattagctaaccttttttaaatggtatacaacagacgacccaaggaaaaccgcccccaaactcctagtatttagtcggtnacatccatttcgactaaaggtcggggtacccagtcgaaggttcaggtgcaggtggatcggtggggctaggtactttcccaccctanaccccattaccgagtccaacggttcctaggcctaaaaccgtggaaaccgttactttcgaacctaaacctttactacgtgtacagtacttacgttacttaacgaggttacgggcccggaccgttaccgttcggacccggagggggtaacagcgttaggagtataccgggaaacgtacgtgggtgacctcggactaaccctntccgttacgtcttcctacgttacccgttcccgaccttataccgtacgaccgtaccacgggaacgacggccgttaggacgggcccggtagtacggaccgg

SEQ ID NO: 341628 - DNA, 636 bp, Homo sapiens
  misc_feature: GZ8MTXP02H9XFN.8.67.G01.1.454.CMB.2.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
tcagctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagctacttttaatggtancaacagagcccaaggaaacnccccaaatctgtattatggtncatccattcganaagtcgggtccatacgaagttcagtgcaggtgatcgtgggacagtatttccaccctnaccatcagcagtctgccaaaccgtgaactactttgaccttaactttactacttgtacagctacgtacttaacacggtacgggcccggtactaccgtttacgggaccgtacgggggacgtaacggacgtagggacgacgttaacggaaacgtaaccgtgggttacggcgtacggaccgtaacctaagttccgttacggttacctttactaccgtttccccgttaccccgtaccgtaacttccggtacggtaacgaaccgtaccggacggtaacgtcgtaacgggtacgccgggggtctacgggccggtaaacggcggaacg

SEQ ID NO: 341629 - DNA, 577 bp, Homo sapiens
  misc_feature: GZ8MTXP02JAB63.8.67.G01.1.454.CMB.2.raw
  modified_base (178)..(178): a, c, t, g, unknown or other
  misc_feature (178)..(178): n is a, c, g, or t
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggnaagtcagaccattagctaacctttttaaatggtatcaacagacgcccaaggaaaacncccccaaatcctgatttanggtncatcctattcgacaaaggtcgggtacccagtcgaaaggttcaggtggacaggtggatcgtggggcagtactttccaccctcaccatcagcagtctacgactaaccgtgaacgttactttgacctaaactttacctacgtgtacagtctagtacttacgacggtacggccggtctaccgttcggaccgaggggacgaagcgtaggagacgtacgaacgtacgtggtacgcgtgaccacgtattcgtcgtactctacttccgtcccactatacgtacgaacgaccaccggaagcgtaggacgggcgcgtacggacaacggg

SEQ ID NO: 341630 - DNA, 578 bp, Homo sapiens
  misc_feature: GZ8MTXP02HEPDK.8.67.G01.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccattcgacaaagtgggtcccatcaaggttcagtggcagtggatcgtggggcagatttccaccctnaccatcagcagtctgcaacctgaaacgactttgacctaaacttactactgtacagcagtctacagtacggccgggctaccgtttggaccgtagggggacgaagcgtagggagtagtacggaaacgtaacgtgggtacgcgtacggacaccgtaattctgttccttctacttcccgttacccgcctactaccgttgaacgaccgaccggaacgacggtaccgttggacgggtcccggggacgtcgggaaccgg

SEQ ID NO: 341631 - DNA, 602 bp, Homo sapiens
  misc_feature: GZ8MTXP02ID5T1.8.67.G01.1.454.CMB.2.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccaaactcctgattttanggtnctatccattcgacaaagtcggggtacccatcaagttcaggtgcagtggatcgngggcagtctttcaccctnaccagtcagcagtctgcaacctgaaacgtctttgactaaacttctactgtcagtcagttactacgacggtaacggcccgggctaccgtttcgggaccgagggggaccgaagtcgtagggaagtactacggaaacgtacgtggttacggcgtaggaccaacgtcttctccggttcttaccgactttcctttacccggccttaacttccgtagaacggtcctaacggaacggacccgtttacggtacggacgggaccgggtacggtacggtacgg

SEQ ID NO: 341632 - DNA, 562 bp, Homo sapiens
  misc_feature: GZ8MTXP02FMVBB.8.67.G01.1.454.CMB.2.raw
  modified_base (331)..(331): a, c, t, g, unknown or other
  misc_feature (331)..(331): n is a, c, g, or t
  modified_base (555)..(555): a, c, t, g, unknown or other
  misc_feature (555)..(555): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagacccaaggaaaacgccccccaaactcctgtatttatggtgcatccatttcgcaaaggtggggtcccatcaaggttcagtggcagtggatgtggggcagatttccaccctnaccatcagcacgtctgaccaacctgaaacgtacttttgacctaaactttactaacttgtactaggctagttctttaaccgagttacgggcccgggtctaccgtttcgggacccgaagggggtacgaaagcgtagggagacgtacgaaacgactggtgcctagccacatctgttctctactccttaccgctatctacgacgcacgcgacgcgtagacggcggtcncgggaac

SEQ ID NO: 341633 - DNA, 568 bp, Homo sapiens
  misc_feature: GZ8MTXP02HNVP7.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggcaagtcagaccattagctacctttttaaatggtatcaacagagacccaaggaaacgcccccaaactcctagtatttagtggtgcatccatttcgacaaaggtcgggtcccatcgaaggttcagtgcaggtgatcgtgggcagtactttcaccctcaccatcagcagtctgctaacgtgaagtactttgacctaacttactactgtacagtctagttacctacgagtacggccggtctaccgttggaccgtaaggggacgtagcgtaggacgagtacgaacgactggtagcgtgaccgtactgtacttgttaccttctacgttcccgtcccgacttactacgtacgacgtaccacgcgtacgcgtacggacggtccgggcgtacggacgg

SEQ ID NO: 341634 - DNA, 594 bp, Homo sapiens
  misc_feature: GZ8MTXP02IJ5AI.8.67.G01.1.454.CMB.2.raw
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccggcaagtcagaccattagcttaacctttttaaatggtatcaacagacgacccaaggaaacgccccaaatcctgtatttagtggtgcatccatttcgacaaaggtcgggtcccatcgaaggttcaggtgcaggtgatcgtggggctagtctttacccaccctcaccatcagcagtctagacctaacgtgaacgttactttcgacctaactttactacgtcgtcagtcagttactacgagtacgggcggtactacgttcgggacgtaagggggactaagcgtagggacgtaacgtaccggtaaacgtacgtgggtacgtccgtacgaccgtacctagttcgttcgttactctaccttcccgttacccgaccttagtccgtagaaccgacacgngtacncggtagacggcggtcgacggacg

SEQ ID NO: 341635 - DNA, 523 bp, Homo sapiens
  misc_feature: GZ8MTXP02HIL8G.8.67.G01.1.454.CMB.2.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaaacagagcccaggaaaagcccccaaatcctgatttanggtncatcattcgcaaagtgggtccatcaaggttcagtggcagtggatctgggcagatttcacctcaccatcagcagtctgcccaacctgaaagtactttgacctaaacttactactgtacagcctagtcttaacagtaggccggcaccttggccaggggacaagctggagatcgaaanaacgtgtggactggcaacntcgtntctctactctcctaccactctacgacgacgacgacgacgacgtaagacggacggcgtacgacgacgacgcg

SEQ ID NO: 341636 - DNA, 569 bp, Homo sapiens
  misc_feature: GZ8MTXP02IS3C4.8.67.G01.1.454.CMB.2.raw
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctaacctttttaaattggtatcaacagacgacccaaggaaaacnccccaaactcctgatttatggtncatccatttcgacaaaggtcgggtcccatcaaggtcagtgcagtggatcgtggggcagtactttcccacctcaccatcaagcacgtctgacaaacctgaaacgttcttgacctaaacttacgtactgtacacgtctagttcttaacgaggtacgggtccggtactaccgtttcgggaccggaagggggaacgaagcgtagggaacgtacgtaacggaaacgtacgtggtgcctgacactatctgtctctactcctccgctactcgacgacgaccacgtcgacgtcgacggacggcggacgcggaacgg

SEQ ID NO: 341637 - DNA, 558 bp, Homo sapiens
  misc_feature: GZ8MTXP02F7E1C.8.67.G01.1.454.CMB.2.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (514)..(514): a, c, t, g, unknown or other
  misc_feature (514)..(514): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgccccccaaatcctgatttanggtncatccatttcganaaagtgggcccatcaaggttcagtggcagtggatgtgggcagtatttccacctcacatcagcagtctgacccctaaaccgtgaaacgtactttgaccttaacttctactgtcagcagttcttacgagttacggcccggctacgttcggacgtaggggaccaagcgtaggacgagtacggaaacgacgtaggtgctgaccaccgtatctgttctcgtactcccgttcccgcacttcgacgaacgacnccggtacgagtccgtggacggcgggccgtggacgacggcgaacg

SEQ ID NO: 341638 - DNA, 555 bp, Homo sapiens
  misc_feature: GZ8MTXP02GKRMR.8.67.G01.1.454.CMB.2.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttanggtncatccatttcgcaaagtgggtcccatcaaggttcagtggcagtgatctggggcagatttcaccctcacatcagcagtctgcccaacctgaacgtactttgacctaaactttacctaactgtcagtcaaggttcctttaacagtaggcccggggctaacccgtttgggacccgtaagggggaccgaaaggtcgtagggagataccggaaacgtaacgtggtacggctggaccaccatctgtcttcatccttcccgcactctacgacacacgcgagcgtgacgcgggctcggacaacggcgac

SEQ ID NO: 341639 - DNA, 631 bp, Homo sapiens
  misc_feature: GZ8MTXP02HQ72L.8.67.G01.1.454.CMB.2.raw
tcagctcgcgtgtccacgaccggtgctcgatttagagtatacatattggggttttgggggctcagctcctggggctcctgctactctggctccgaggtgccagatgtgacatccagatgacccagtctccatcctccctgtctgcttctataggagacagagtcaccatcacttgccgggcaagtcagaccattagctaactttttaaatggtatacaacagacgaccaaggaaacgcccccaaatcctgtatttagtggtgcatccatttcgacaaaggtcggggtcccatacgaaggttcagtggcaggtggatcgtggggcagtactttccaccctcacctatcagcagtctacgacaacctgaacgtactttcgactaaactttacgtaccttgtacaaggtctaagttcttaacgaggtacgggcccgggtactaccggtttcgggaccggaacgggggaacgacggtcgtagggaacgtaacgttaccggaaaacggtaacgttgggtcgggactacggacctaccgtattccgttcgttacttcgtaccttcccgtttcccacttacttcgtacgacgacgacggaaccggtcgtacggtacggacggcgggtacgtacggacg

SEQ ID NO: 341640 - DNA, 574 bp, Homo sapiens
  misc_feature: GZ8MTXP02F336J.8.67.G01.1.454.CMB.2.raw
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
tcagctcgcgtgtccacgaccggtgctcgatttagagtatacatattggggtttgggggctcagctcctggggctcctgctactctggctccgaggtgccagatgtgacatccagatgacccagtctccatcctccctgtctgcttctataggagacagagtcaccatcacttggccgggnaagtcagaccattagctaacttttttaaatggtatcaacagancccaaggaaaacncccccaaatcctgatttatggtgctatcctatttcgacaaaggtcggggtcccatcgaaggttcaggtggcagtggtatcggtggggcagtatttcccaccctcaacctntcagcacgtctgactaaacctgaacgttctttgactaaacttacactgtacagtctagttacttaacgacggtacggcccgggtactaccgttggaccgaaggggacaagctaggganagtacgaacgactgtcggactgacctaccatctcgtctactctccgttcccgactacgttcacgaacgaccgacggccgagtccgtaggacgggccggtacggcggacg

SEQ ID NO: 341641 - DNA, 711 bp, Homo sapiens
  misc_feature: GZ8MTXP02GZZ6H.8.67.G01.1.454.CMB.2.raw
  modified_base (611)..(611): a, c, t, g, unknown or other
  misc_feature (611)..(611): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacgttcggccgggacaagtcacgacctatttaacgaccttaaccttttttaaattggtaatacaaacgaagacgacccgaaggaaaacccgacccctaaactccctagtactttagtaggtcactactcctattccgacgtaaacgggtcgggtacccagtacgaaggttcaggtgacgaggtgatcggtacggggctaagttacttaccaccctacacactcacgtactacgttcctacgacctaaacgtagaaacggtttaccttcggtaaaccttaactttacctacgttagtaccaacgtacgtacgtttaccgttaacgtacggggtaccgggtcccggtaccgttaccgggttccggggaccggtaagggggaacgacggtcggtaaggtaacgaacgtacgggaaacgtacggtggtacgtcgtacacctaacgtnttcgttacttcgtccttaccgttcccgtacccacgttccgagtaccggaaaccgcggtcgaacgtacgcgtacgggacggtccggtcggaacggggtacg

SEQ ID NO: 341642 - DNA, 578 bp, Homo sapiens
  misc_feature: GZ8MTXP02I0A8E.8.67.G01.1.454.CMB.2.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatgtatcaacatagcccaaggaaaacnccccaaatctgattanggtgcatccatttcgacaaagtggggtccccatacgtaaggtcagtggcaggtggatcgtggggctagaatttccaccctaccnccatcagcacgtcngacacgtagaacgtcttcgactaaacttactactcgtacacgtctacgttacttacgacggtacgggccggtctaccgttcggacggaaggggacgagtcgtaggagtacgacggtaacgacgtggtcggcgtacgacctactacttcgttcgttacttactacttcccgttccgactacgttacgtacgacgaccgacggtcgacgtcgacggacggcggcgtacggacg

SEQ ID NO: 341643 - DNA, 575 bp, Homo sapiens
  misc_feature: GZ8MTXP02GPDRH.8.67.G01.1.454.CMB.2.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (297)..(297): a, c, t, g, unknown or other
  misc_feature (297)..(297): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctactttttaaatggtatcaacagancccaaggaaacncccccaaatcctgatttanggtncatccattcganaagtgggtccatcaagttcagtgcagtgatcgnggggcagtatttcaccgtcacatcagcagtctagcccaacctgaagtctttgacctaaacttcctactgtcaacgtctaaggttcctaagaggttacgggcccggtacctaacgtttcggaacgacgggggacgaacgccgtagggagacgtacggaaactaacggtcgtgactacggaccacccgtatccgttgtccttctaactccttacccgcctatccgtggaaaccgccgacgacggacgtcgtgacggacggcggacggacgacggacgacg

SEQ ID NO: 341644 - DNA, 586 bp, Homo sapiens
  misc_feature: GZ8MTXP02I439N.8.67.G01.1.454.CMB.2.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (532)..(532): a, c, t, g, unknown or other
  misc_feature (532)..(532): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacncccccaaactcctgtatttanggtgacatcctatttcgacaaaggtcggggtacccatcgaaggttcagtggacnggtggatcgtggggnagtatttccacctcacccatcgagctagtctagaccctaacctgaaagtctttgacctaaacgtttctaccgtgtccaaggctaacggttacttaacgagttacgggcccgggactaaccgtttcggccgtaaggggacgtaagcgtaggagatacggaaacgactcgggtgacctgaccacctgtcctgttacttcagtccttcccgacnctctcgaacgacgaccggcagacgtggcggcggtacgcggactaacgggcgacg

SEQ ID NO: 341645 - DNA, 553 bp, Homo sapiens
  misc_feature: GZ8MTXP02GXFTP.8.67.G01.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (458)..(458): a, c, t, g, unknown or other
  misc_feature (458)..(458): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttggccgggcaagtcagaccattagctaactttttaaatggtatcaacagacgaccaaggaaaacgccccaaatcctagatttagnggtncatcattcgacaaagtcgggccatcgaaggttcagtgacgtagtggatcgtggggctagtactttcgaccctcacccatcgagcagtctagacccaaccgtagaactactttgacttaaacttctactgtacagctaatacttacagccggacggctacgttggaccgagggacgagcgtaggagacgtacgaacgtaagngtggactacgaccagtactntcgtctcgacttcctccgactntacgngacggacacgcgacgcgtaacggcggacggtcacggacgacggcgaag

SEQ ID NO: 341646 - DNA, 748 bp, Homo sapiens
  misc_feature: GZ8MTXP02IL2QP.8.67.G01.1.454.CMB.2.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttggccgggacaagtcagacctattagctaactttttaaatggtatacaacagacgacccaaggaaaaccncccccaaactcctagtatttagtggtncactcctagttcgactaaggtcgggtacccagtacgaaggttcaggtggacaggtgacgtcggtaggggctaaggtactttacccaccccgtacaacccgtatacgagcctacggtcctacgaacctaacgtgtaaacttacttcgaacctaaaccttacgtacgttcgtacaacgtcttacgttactaacggtaggtaccggggtcccggtacgttacccggttacggggaaccccgggtaagggggtaacgaaggtaccggtagggaaccgtaaaggtaacccgggtaaaccggtaacggttcgggtaccggtaccgtaccggaaccctaccgtacgtttaccgttccgtttaccttaccgttacccgtttaccccgtaccccgtaccgttaaacgttccggtaacgaacccgaaccgtaaccgggtcggtaacgtcgggttacgggacgggtccggggtacggaacgggaacccggg

SEQ ID NO: 341647 - DNA, 560 bp, Homo sapiens
  misc_feature: GZ8MTXP02IPPG2.8.67.G01.1.454.CMB.2.raw
tcagctcgcgtgtccacgaccggtgctcgatttagagtatacatattgggtttgggggctcagctcctggggctcctgctactctggctccgaggtgccagatgtgacatccagatgacccagtctccatcctccctgtctgcttctataggagacagagtcaccatcacttgccgggcaagtcagaccattagctacctttttaaatggtatcaacagagcccaaggaaaacgcccccaaatcctgatttatggtgcatcattcgacaaagtgggtcccatcaaggttcagtgcagtggatgtggggcagtactttcaccctcaccatcagcagtcagcaactgaatacttgactaacttactactgcacgctagtctacgaggtcggaccggctaccgttcggaccgtaagggggacgacgacgtagggaagacgtacggaacgtaacgttgggtgggactggacctaaccagttcgttcgttccttacctacttcccgtttacccgactaacttcgtacgacgaccacggcgacgcgtcgacggcggcgtacggacg

SEQ ID NO: 341648 - DNA, 693 bp, Homo sapiens
  misc_feature: GZ8MTXP02HAFO1.8.67.G01.1.454.CMB.2.raw
  modified_base (460)..(460): a, c, t, g, unknown or other
  misc_feature (460)..(460): n is a, c, g, or t
tcagctcgcgtgtccacgaccggtgctcgatttagagtatacatagttgggtttgggggcttttcctgggctcctgctactctggctccgaggtgccagatgtgacatccagatgacccagtctccatcctcctgtctgcttctataggagacagagtcaccatcacttgccgggcaagtcagaccatagctaacctttttaaatggtatcaacagacgaccctaaggaaaacgcccccaaactccttagtatttagtggtgactatcccgatttccgacaaaggtcgggtacccagtccaaggttcagtggcaggtggatcggtaggggctaagtactttccgaacccttacgaaccctaattcaacgtcgtaacgtcgtacgaccgtaaaacccttgggaaaacttaccttttacggaacccttaaaacgtttccgtaaccttggacccgttaaaccncctaaacggtttacctaacgaacgtacgggcccggtactacggttcggacggaaggggacgtacggtacgtaggaagacgtaacgaacgtaacgtcgtacgactcgaccgaactctacgttacgtacttacgtaccgttaccgtcccgtacgtacgtccgaagaaccgaccggaaccgtacgaccgtcggtaacggacggtaccgggtccgacggtaaccgaccggtactacg

SEQ ID NO: 341649 - DNA, 525 bp, Homo sapiens
  misc_feature: GZ8MTXP01APSNF.9.33.C11.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaactggccaggctcccaggcccctnatcttgatgcatccatcaggccatggcatcccagccaggttcagtggcagtgggtctgggacagaacttcaactctcaccatcagcagcctagagcctgaagtattttgctagtttattactgtacaacatcggtaccgagttcggcccgtccgggggcctacgtttcggccctgggaccaaagttcgagaatcaaacgaacttggtgcttgcaccaatctgtctcactcttccgcc

SEQ ID NO: 341650 - DNA, 549 bp, Homo sapiens
  misc_feature: GZ8MTXP01DIRN9.9.33.C11.1.454.CMB.2.raw
  modified_base (306)..(306): a, c, t, g, unknown or other
  misc_feature (306)..(306): n is a, c, g, or t
  modified_base (529)..(529): a, c, t, g, unknown or other
  misc_feature (529)..(529): n is a, c, g, or t
  modified_base (544)..(544): a, c, t, g, unknown or other
  misc_feature (544)..(544): n is a, c, g, or t
tcagtgatacgtctcacgaccggtgctcgatttagagtgagctcgttgggtttgggctgagctgggttttcctcgttgctcttttaagaggtgtccagtgtcaagtgcaactggtggagtcgtgggggggcgtggtccagcctgggaggtccctgagactctcctgtgcaggctctggattcaccttcagtaactacggcgtgcactgggtccgccaggctccaggcaagggcttggagtggctggcagttgttcatctagaaggatgttcaatacatacagactcgtgaaggccattcaccatcncagagacaattccaaagaacacgatgtatctgccaaatggacagcctaaaagagttgagacacggtctagtttatactgtacgaaagagggggatacgagtgacagctacaagtactacttagacttcggtcggggccaggggaccctggtccaccgtctacctcacgcctccaccgaacgggcccagtccggttccttccccgtggccgcccttgccctccnggacgccacctccgngaacg

SEQ ID NO: 341651 - DNA, 520 bp, Homo sapiens
  misc_feature: GZ8MTXP01BI4WN.9.33.C11.1.454.CMB.2.raw
  modified_base (200)..(200): a, c, t, g, unknown or other
  misc_feature (200)..(200): n is a, c, g, or t
  modified_base (363)..(363): a, c, t, g, unknown or other
  misc_feature (363)..(363): n is a, c, g, or t
tcagtgatacgtctcacgaccggtgctcgatttagagtgagctcgttgggtttgggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttaccaccagttagcctggtaccaacacaaacctggccaggctcccaggcccctcatctttgatgcatccatcagggccactggcatcccagccaggttcagtggcagtgggtcctggggacagaacttcnctctcaccatcagcagcctagagcctgaagattttgctagtttattactgtcaactatcggtaccgagtcgccgtccgggggccacgtttcggcctgggtaccaaattgagaatcaaagaacttgtagcttgcacaatctgtctcactcttcccgcc

SEQ ID NO: 341652 - DNA, 534 bp, Homo sapiens
  misc_feature: GZ8MTXP01A0KO8.9.33.C11.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (506)..(506): a, c, t, g, unknown or other
  misc_feature (506)..(506): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccaggggaaanagccaccctctcctgcagggccagtcagagtgttaccaccagttagcctggtaccaacacaaacctggccaggcctcccgggcccctnatctttgatgcatccatcaggccatggcatccccagcccaggttcagtggcaggtcgggtctgggacagacttcactcncaccatcagcagcctagngcctgaagtatttgactagtttatactgtcaacatcgtacggagtcggccgtccgggggcctacgttccggccctacggggaacctaaaagttgacgataacaaacgactgcgcgtgcnccatctgtcttcacttcctcccgctaac

SEQ ID NO: 341653 - DNA, 535 bp, Homo sapiens
  misc_feature: GZ8MTXP01CSSJ7.9.33.C11.1.454.CMB.2.raw
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaaagaacacgatgtatctgcaaatggacagcctaagagttgaggacacggctgtttatactgtacgaaagagggggatacagtggcagcctccaagtactactttgaaacttctggggccagggaccctggtcacgtctctcagcctcaccaagggcccatccgtcttcccctggccnccctgcctccgaggcnccacctccgagcgcacagccgccctgggctcgccttggtcaggacctcttccgagccgtaatccaacgtgacgcgggtcttggaacg

SEQ ID NO: 341654 - DNA, 603 bp, Homo sapiens
  misc_feature: GZ8MTXP01DFPCB.9.33.C11.1.454.CMB.2.raw
  modified_base (285)..(285): a, c, t, g, unknown or other
  misc_feature (285)..(285): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaagcgccaccctctcctgcagggccagtcagagtgttaccaccagttacgcctggtaccaacacaaactgcagctccagcccctnatcttgatgcatccatcgacgggcccacgtggacactccccgagcctaggttcagtggctaggtgggtcgtgggacagtaacttcaactctcaccatcagcagcctagacgctagaagttatttgacttaagttttactacttagtactaaactacgttacgggtaccggtaggtccgggtcccggtcccgggggtccctacggttttcccgggacccgttacggggtaaaccctaaaagttcggaagtaactaacgaaacgtacgttggtacggcttcggccaccaattctgttctcttacttcccttcccgtaacc

SEQ ID NO: 341655 - DNA, 538 bp, Homo sapiens
  misc_feature: GZ8MTXP01CH1IL.9.33.C11.1.454.CMB.2.raw
  modified_base (476)..(476): a, c, t, g, unknown or other
  misc_feature (476)..(476): n is a, c, g, or t
  modified_base (509)..(509): a, c, t, g, unknown or other
  misc_feature (509)..(509): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcgtgggttttcctcgttgctctttaagaggtgtccagtgtcaagtgcaactggtggagtcgtgggggggcgtggtccagcctgggaggtccctgagactctcctgtgcaggctctggattcaccttcagtaactacggcgtgcacgtgggtccccgccaggcctccaggcaaggggcttggagtggctggctagttgttcatctgaaggagtgttacaataactataacagactccgtagaacggggccaattcaccatctccagagacaattaccaaagaacaagatagtatctaggacaaatggaacagacctaagagttagagacgacgntgttaatattgtacgaaaggagggggattacgngttgcagctcagttactaacgttgtaacg

SEQ ID NO: 341656 - DNA, 547 bp, Homo sapiens
  misc_feature: GZ8MTXP01DCLX7.9.33.C11.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (524)..(524): a, c, t, g, unknown or other
  misc_feature (524)..(524): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaaancgccaccctctcctgcagggccagtcagagtgttaccacccagttacgcctggtaaccaacacaaacctggccaggcctcccaggcccctnatcttgatgcatccatcaggccactggcactcccagccaggttcagtggcaggtgggtctgggacagaacttcaactctcacctatcagcagcctagagctgaagtatttgactagttttatactgttacaaatactacggtaccgaggtcggccgtaccgggggcctacgtttcgacccgtgggaaacctaaagtcgaagtaactacgaaacgacttgtggcttgcactntctcgtcttcacttccttcccgc

SEQ ID NO: 341657 - DNA, 523 bp, Homo sapiens
  misc_feature: GZ8MTXP01BHQMJ.9.33.C11.1.454.CMB.2.raw
  modified_base (203)..(203): a, c, t, g, unknown or other
  misc_feature (203)..(203): n is a, c, g, or t
  modified_base (487)..(487): a, c, t, g, unknown or other
  misc_feature (487)..(487): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctggggacagaacttcaactctcaccatcagcagcctagagcctgaagattttgcagtttattactgtcaacatcggtacgagtggcctccgggggccactttcggccctgggaccaaaattgagaatcaaacgaacngtggcttgcaccaatctgtctcttatcttccgtccc

SEQ ID NO: 341658 - DNA, 545 bp, Homo sapiens
  misc_feature: GZ8MTXP01D8Y01.9.33.C11.1.454.CMB.2.raw
  modified_base (328)..(328): a, c, t, g, unknown or other
  misc_feature (328)..(328): n is a, c, g, or t
  modified_base (446)..(446): a, c, t, g, unknown or other
  misc_feature (446)..(446): n is a, c, g, or t
tcagtgatacgtctcacgaccggtgctcgatttagagtgagctcgttgggtttggggcgtggtccagcctgggaggtccctgagactctcctgtgcaggctctggattcaccttcagtaactacggcgttcactgggtccgccaggctccaggcaagggcttggagtggctggcagttgtttcatctgaaggaagtgttcaatactatacagactccgtgaaggccattcaccatctcagagacaattccaaagaacacgatgtatctgcaaatggacagcctaaagagtgaggacacggctgttatactgtacgaagagggggatanagtgcagctcccaagtactacttgacttcgtgggccagggaaccctgggtcaccgtctcctcacgcctccacgaaggcccatccggtctcccctggccgccctgcctccgaggggacnccacctccgagacgcacacgccggcccgtgggcctggaaccctgggttcaaacggactacttccgagccgttatccactggagcgggctcggcgaacgg

SEQ ID NO: 341659 - DNA, 662 bp, Homo sapiens
  misc_feature: GZ8MTXP01BZEKJ.9.33.C11.1.454.CMB.2.raw
  modified_base (252)..(252): a, c, t, g, unknown or other
  misc_feature (252)..(252): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcgtggtttcgtcgtaggctctttaagaggtgtcagtgtcaagtgcaatggtggagtcgtgggggggctggtccagcctgggaggtcctgagactctcctgtgcgngctctgtctctactctagtacgacggcgtcgcacgtcggtccgccgacgcgtcgacggacgaggtcgtggaggtggcgtcgtcgtagttgttctatcgtagtaaggtagtagtactaactaactaaactaactaacgtacgtacgtacggacggacgtactactactactactacgagaacgaactaactaacaaacgaaacgaacgtaacgtacgtaactacgtacgaacggtaaacgtaacgaacgtaacgtaacgtaacgtaacggtacggtaacggtaacgtacgtacgttacgttaagttaacgtaacggttaaacggtaaagggaaggggtaacggtaacgttacggttcggttacgtaacgtacgtaaccgtaacgtacgttacgttaacgttaacgtaacgg

SEQ ID NO: 341660 - DNA, 551 bp, Homo sapiens
  misc_feature: GZ8MTXP01BA7X4.9.33.C11.1.454.CMB.2.raw
  modified_base (287)..(287): a, c, t, g, unknown or other
  misc_feature (287)..(287): n is a, c, g, or t
  modified_base (360)..(360): a, c, t, g, unknown or other
  misc_feature (360)..(360): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaactggccaggctccaggcccctnatcttgatgcatccatcagggccatggcatcccagccaggttcagtggcaggtgggtctgggacagaacttcnctctcaccatcagcagcctagacgcctgaagtattttgctagtttattactgtacaactatcggtacgagttcggcccgtccgggggcctacgtttccgggccccgtggggtaacccaaaagttgaagtaactacgaaacgtacttggtcggcttcgcacctaatctgttcttcttactccgttcccgaac

SEQ ID NO: 341661 - DNA, 596 bp, Homo sapiens
  misc_feature: GZ8MTXP01DH04P.9.33.C11.1.454.CMB.2.raw
  modified_base (204)..(204): a, c, t, g, unknown or other
  misc_feature (204)..(204): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccacctgtctttgctccgaaggggaaanacgccaccctctcctgcagggccagtcagagtgttacccacctagttacgcctaggtaaccaacaacaaacctggaccaggcctcccgacggcccctcacttctttgatcgcatccatcgagggccacgtggcactcccagcctaggttcaggtggcaggtgggtctggggacagtaccttcaactctcaccatcagcacgcctagacgcctagaagttatttgacttagttttatactgtacaactacgtcggtaaccggtagtccggacccggtccgggggccttacgttccggaccgtagggtaacctaaaagtcgaagaactaacgaaacgtaacgttggtacggcttgccacctaatcttgtaccttcttacttccgttcccgaacc

SEQ ID NO: 341662 - DNA, 555 bp, Homo sapiens
  misc_feature: GZ8MTXP01BRB7D.9.33.C11.1.454.CMB.2.raw
  modified_base (371)..(371): a, c, t, g, unknown or other
  misc_feature (371)..(371): n is a, c, g, or t
tcagtgatacgtctcacgaccggtgctcgatttagagtgagctcgttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaacacggcgtgcactgggtccgccaggctccaggcaagggcttggagtggctggctagttgtttcatctagaaggagtgttacaatactaaatacngactccgtagaacgggccattcaccatctccagagacaattaccaaagaacacgatagtatactagacaaatggaacagacctaaagagttagaggactacggtacttgtttattaactagttaacggaaaggagggggaatacgagttgcgtaagctccgaagtacttactttgaacgttcgg

SEQ ID NO: 341663 - DNA, 578 bp, Homo sapiens
  misc_feature: GZ8MTXP01DY5G1.9.33.C11.1.454.CMB.2.raw
tcagtgatacgtctcacgaccggtgctcgatttagagtgagctcgttgggtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggcagttgttcatctgaaggagtgttcaatacatacagactcgtgaaggccatcacatctcagagacaattccaagaacacgatgtatctgaccaaatggacagcctaaaagagttgagacacggtctgttatactagtacgaaagagggggatacgagtgacagctaccaagtactactttagacgttacgtcggggtcagggtaaccctggtccaccgtctcctcacgcctccgaccgaaacgggccccaacgtcccgggttccttcccccgtcggttcccgccccttcggccctacccgaacgggacgccacccgtcccgaacggaaccg

SEQ ID NO: 341664 - DNA, 533 bp, Homo sapiens
  misc_feature: GZ8MTXP01D6BH9.9.33.C11.1.454.CMB.2.raw
  modified_base (365)..(365): a, c, t, g, unknown or other
  misc_feature (365)..(365): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttcagtaacacggcgtgcactgggtccgccaggctccgaggcaaggggcttggagtggctggcagttgttcatctgaaggatgtcaatactaatacngactccgtgaagggccattcaccatctaccagagacaattacaagaacacgatgatctgacaaatggaccagcctaaagagttgaaggacacggcttgttactaatagttacgaaaggagggggtatacgagttggcaagctccaagtacttacgttgttaacttcgg

SEQ ID NO: 341665 - DNA, 580 bp, Homo sapiens
  misc_feature: GZ8MTXP01A5TUV.9.33.C11.1.454.CMB.2.raw
  modified_base (300)..(300): a, c, t, g, unknown or other
  misc_feature (300)..(300): n is a, c, g, or t
  modified_base (542)..(542): a, c, t, g, unknown or other
  misc_feature (542)..(542): n is a, c, g, or t
tcagtgatacgtctcacgaccggtgctcgatttagagtgagctcgttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcaccttcagtaactacggcgtgcacgtgggtcccncaggctccgaggcaagggcttgggagtggctgggctaggtttgtttcatcgtggaaacggtagttgttacaatactaaatacaagactccgtagaacgggccattcaccatctacagagacaattaccaaagaacacgatagtatactagacaaagtggacagacctaagagttgaggactagggtcttagtttattaacgtagttaacggtaaaggagggggtaagtaacgaggttcgganaacgtctaaccgaagttacttacgttgttaacgttcgg

SEQ ID NO: 341666 - DNA, 606 bp, Homo sapiens
  misc_feature: GZ8MTXP01CTS05.9.33.C11.1.454.CMB.2.raw
  modified_base (568)..(568): a, c, t, g, unknown or other
  misc_feature (568)..(568): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggcgtggtccaggccgtgggaggtccctgagactctcctgtgcaggctctggattcaccttcagtaactacggcgtgcacgtcgggcccgccaggcctccgaggcgaaggggcgttggaggtggctggctagtttgtttcagttcgtaggaaggtaagttgttacaaattaactaataacagtacctcccggtaggaaacgggcctattcccacctactcctaccagaacgaactaacttaccaaagaaccaacgatagtaatactacggacaaagtagacagaccgtaagagttagacggtacacggtcttagtttaacttacgttaggtaacggaaaggtaagggggattacgnggttacggaacagcgtacagttactaacgttgtaaccg

SEQ ID NO: 341667 - DNA, 607 bp, Homo sapiens
  misc_feature: GZ8MTXP01C6S7S.9.33.C11.1.454.CMB.2.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (576)..(576): a, c, t, g, unknown or other
  misc_feature (576)..(576): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctcgaggggaanacgccaccctntcctgcagggccagtcagagtgttaccacctagttagcctggtaacccaacacaaacctggccaggcctcccgaggccccctcatctttgatgcactccatcgacggggccacgtggccactccccaagccctaggttccaggtggctaggtgggtctggggactagaaccttcaacttctacacccatcagcacgcctagacgtcctagaagttattttgacttaagtttattactagtacaactattaccgggtaccggaggtcggccggtccgggggcctaccgtttccggacccgtagggtaaccctaaagtcgaagtaactacgaaacgacgttaggtcgggtcttacggcttacctntctcgttacttcttacttcccttcccgaacc

SEQ ID NO: 341668 - DNA, 553 bp, Homo sapiens
  misc_feature: GZ8MTXP01AJAB0.9.33.C11.1.454.CMB.2.raw
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaaagaacacgatgtatctgcaaatggacagcctaagagttgaggacacggctgtttatactgtacgaagagggggatacagtgcagcctccaagtactactttgaacttctggggccagggaaccctggtcaccgtctcctcacgcctccaccaacgggcccaacgtccggtccttcccccgtggccgccccttgcctccgaggacgcaccctccgagagccacagccggccctgggctcggccttgggtcaaagggcctaacttcccgngaccgtncaactgacgcgggcttggaacg

SEQ ID NO: 341669 - DNA, 626 bp, Homo sapiens
  misc_feature: GZ8MTXP01DGLWE.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctgggtccagccgtgggaggtccctgagactctcctgtgcaggctctggattcaccttcagtaactacggcgtgcacgtgggtccgccaggcctccgagcgaagggcttggagtggctggctagttgttcatctagaaggtaagtgtacaataactataacagactccgtagaacgggtccgattcacctatctaccagagaacaaacttaccaaagaacaacgatagtatactaggacaaagtacgaacgacgaccgtaaaggagttaggaacggtaacgtacggtcttaggttttaacttaacgttaggtaaacgggaaagggtaaggggggtaattaaccggagggttacgggtaacgaacgggtaaccttacccgtaaaggttaccgttaacgttttccggttaaccgg

SEQ ID NO: 341670 - DNA, 577 bp, Homo sapiens
  misc_feature: GZ8MTXP01A5KL7.9.33.C11.1.454.CMB.2.raw
  modified_base (296)..(296): a, c, t, g, unknown or other
  misc_feature (296)..(296): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtgggtccnccaggctccgaggcaagggcttggagtggctggcagtttgttcatcgtagaaggtagtgtacaataactatcagactccgtagaacgggccattccacatctcagagacaattacaagaacacgatgtatctaggacaaagtggacagacctaagagttagaggacgtacggtcttggtttaattaacgttaggtaaacggaaagggtaagggggtaattaacggaggttaggaacacggtcctacccgtaaggttaaccttaacgtttaacgttaacccg

SEQ ID NO: 341671 - DNA, 589 bp, Homo sapiens
  misc_feature: GZ8MTXP01BGKIG.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccgcaggcctccgaggcgaagggcttggagtggctggcagtttgttcatcgtgaaggtagtgtacaataactatcagtactccgtgaacgggccattccacatctacagagacaacttacaagaacacgatgtatctaggacaaagtgaacagaccgtaagagttagaggacgtacggtcttagtttaagttaacgttaggtaaacggttaaagggaaggggggtaattaacggagttagggaacgtacggtaacctacccgtaaagttaccgttaacgtttcggttaacccgg

SEQ ID NO: 341672 - DNA, 550 bp, Homo sapiens
  misc_feature: GZ8MTXP01C4FW3.9.33.C11.1.454.CMB.2.raw
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (464)..(464): a, c, t, g, unknown or other
  misc_feature (464)..(464): n is a, c, g, or t
  modified_base (521)..(521): a, c, t, g, unknown or other
  misc_feature (521)..(521): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccagagacaattccaaagaacacgatgtatctgcaaatggacagcctaagagttgaggacacgctgtttatactgtacgaaagagggggatacagtgnagctcagtctattgaacttcngggccagggaaccctggtcaccgtcncctcacgcctcaccacgggcccatccggtcttccccgngccnccctgcctcgacggacgccacctccgagacgccgaacncgccggccctggggcctcgccttgggtccaaggtacctacttccgagttaccgtaancgaaccgtgacggcgggcgttcgggaacg

SEQ ID NO: 341673 - DNA, 572 bp, Homo sapiens
  misc_feature: GZ8MTXP01BVGRS.9.33.C11.1.454.CMB.2.raw
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (539)..(539): a, c, t, g, unknown or other
  misc_feature (539)..(539): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactcgtgaagggccattcaccatctccagagacaattccaaagaacacgatgtaatctagacaaatggaacagacctaagagttgaggacacggctgtttattacgtgtacgaaaggaggggggatacgagtgcagcctacaagtactacttgaacttcgngggcacgggacctggtcacgtctccncacgcctaccacaacgggcccacgtccggtccttccccgtcggccgccctgcctcgacggcgccaccgtccgagcgcacgacgccgcccgtgggctcggcccttggggcaacgggaccttaccttccgacgggaccttntccgtaacgtcggacgcgggccgttggaaccgg

SEQ ID NO: 341674 - DNA, 597 bp, Homo sapiens
  misc_feature: GZ8MTXP01DFQN0.9.33.C11.1.454.CMB.2.raw
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtgggggggggctggtccagccgtggggagtccctgagactctcctgtgcaggctctggattcaccttcagtaacacggctgcacgtcgggtcccnccgaggcctccgaggcgaaggggcttggagtggctgggcagttgtttcatcagaaacggagtgttacaatactaaanacngactccggagaagggccaatcacatctacagagacaatacaagaacacgatagtatctanacgaaagtaggaacacgacctaagagttagaacgacgtacggtacttagtttaattaacgtaggttaaacgggaaagggagggggtaactaacgaggttcggacgtaacgactaaccgtaaggtacttacgtttcgaaccgtttaaccggg

SEQ ID NO: 341675 - DNA, 722 bp, Homo sapiens
  misc_feature: GZ8MTXP01C6AKL.9.33.C11.1.454.CMB.2.raw
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtgggagtccctgagactctcctgtgcaggctctgacttcaccttcagtaacacggcgtgcacgtcgggtcccgccgaggcctaccgaggcgaaggggtcttagggagtgggcgtagggtctaggttttgtttcagttcgtaggtaaacggtaagttcgttactaaaacttacttaaactaacgaacggtaccgttacccgggtagggaaacggggccccgtaatttacccaaccctattcctaccgaagaacgaacctaaattaccaaagaacacgatagtatacgtagacaaagtcggaactacgtaccgtaaagtagttacggaaacggtacgtacgggtaccttaggttttaaacgttaagttaacgggttaaaccgggtaaaagggggttaaggggggtaaattaacggttaaacgggttggaccgtaacgtacccgtaacgtaaacgttaccgtttaacgtttaacggttaacgtttccgggg

SEQ ID NO: 341676 - DNA, 725 bp, Homo sapiens
  misc_feature: GZ8MTXP01B3GI9.9.33.C11.1.454.CMB.2.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtgggggggggctggtccagccgtggggagtccctgagactctcctgtgcaggctctggattcaccttnagtaacncggcgtgcacgtgggtccnccaggctccgaggcgaagggcttgggagtggctgggctagtttgttcatcgtagaaacggtagtgtacaatactaatacgaagactccggtaggaacgggccgtaattccaacctatacctaccgaagaacgaaactaaacgttacccgaaaagtaaaccaacgtatacgtaatacgttacggaactaaaagtacgggaaacctaacggtaacccgttaaaggtacggtttaggaaacgggtaaccgtaaccggggtacgtttaggttttaaacgtttaaccggttaaaggggttaaaccgggaaaagggggttaaggggggtaaactaacgggttaagggttcgggaccgtaacggtacccgttaaccgtaaacggttaccgttacgttttaacgggttaaccgtttaacccggggg

SEQ ID NO: 341677 - DNA, 521 bp, Homo sapiens
  misc_feature: GZ8MTXP01BCXIL.9.33.C11.1.454.CMB.2.raw
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagtgatacgtctcacgaccggtgctcgatttagagtgagctcgttgggtttggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctcagagacaattccaaagaacacgatgtatctgcaaatggacagcctaagagttgaggacacggctgtttatactgtacgaaagagggggatacagtggcagcctcaagtactattttgaacttcgtgggccagggaaccctggtcacgtctctcagcctcaccaagggcccagtcgtctcccctggcncctgcctcgngacncacctcgacgagcaacncgcggcctgggctcgccttggtcaaggctacttccgngacgtaacncaacgngngcggtcgngn

SEQ ID NO: 341678 - DNA, 632 bp, Homo sapiens
  misc_feature: GZ8MTXP01B0N2P.9.33.C11.1.454.CMB.2.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccacctgtctttgctccgaggggaangccacctctcctgcagggccagtcagagtcgttaccaccagttacgcctggtaccaacacaactggccagctccaggcccctnatcttgatgcatccatcgaggccatggcatcccagcctaggttcaggtgcaggtgggtctgggacngaacttcnctctcacatcagcagcctagacgctagaagtattttagacttagtttattacgtagtactaaactacgttaccgggtaacggtacggttccgggccccggttcccggggggtccctaaccggtttccgggtaccccgttacggggaaaccctaaaacgttggaacgtaacgttaaccgaaaacggtaaaccgttggtacgggtccttacggccgttaaccgtaacgttccgttaacgtttccttcgttaccgtttcccgtttcccccggtaaccc

SEQ ID NO: 341679 - DNA, 581 bp, Homo sapiens
  misc_feature: GZ8MTXP01ADRLY.9.33.C11.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgctccaaggggaaangcccaccctctcctgcagggccagtcagagtgttaaccaccagttagcctggtaccaacacaaacctggccaggctcccgaggcccctnatcttgatgcatccatcagggccactggcactcccagccaggttcagtggcaggtgggtctggggacagaacttcnctctaccaccatcagcacgcctagacgcctagaagtntttggacttagtttaatacttgttacaacgtattccggggtaacgaggttcggcccggttcccgggggccctaccggtttccggccccgtagggtaacccaaaagttcgaagaactaacgaaacgtacttggtacgcttgccacctaatctcgtacttcacttccttcccgaacc

SEQ ID NO: 341680 - DNA, 592 bp, Homo sapiens
  misc_feature: GZ8MTXP01D5X8L.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggaggtcggtggggggggcgtggtccagccgtgggacgtccctgagactctcctgtgcaggctctggattcaccttcagtaactacgggctgctacgtcgggtcccgccaggcctacccgaggcaagggggtcttagggaggtggcttgggctagtttgttcagtctaggaaggaagtgttacaataactatcagtacctaccggtagaacggggccattccacctaatctaccagacgaactaaacttacaaagaacacgatagtaatctaggacaaatacgacagctaagagtagaggtacacgtctgtttaattagttaggtaaacggttaaaggagggggtaattacgaggttaggcacgctacaagttacttaacgtttcgttaaccg

SEQ ID NO: 341681 - DNA, 593 bp, Homo sapiens
  misc_feature: GZ8MTXP01BDUMV.9.33.C11.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccacctgtctttgtctccgaaggggaaancgccaccctctcctgcagggccagtcagagtcgttaaccaccagttacgcctaggtaaccaacacaaacctggccaggctcccaggcccctnatctttgatgcatccatcgaggccacgtggcactccccagcctaggttcaggtggctaggtgggtctgggactagtaccttcaactctcaccatcagcagcctagacgctagaattatttgacttagtttacttactagtactaactacgttacgggtacggtaggttccgggccggttcccgggggcctaccggtttccggacccgttacggggaaacctaaaagttcgaacgtaactaacgaaacggtacgttggcgtcttcgccactaatctcgttctacttcttccgttcccgc

SEQ ID NO: 341682 - DNA, 617 bp, Homo sapiens
  misc_feature: GZ8MTXP01AY5FB.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgcttctttaagaggtgtccagtgtcaagtgcaactggtggagtcgtggggggggcgtggtccagcctgggaggtccctgacgactctcctgtgcaggctctggattccaccttcagtaacacggcgtgcacgtgggtcccgccaggcctccgaggcgaaggggtcttgggagtggctggctaggtttgttcatcgtagaacggtagttgttacaatactaaatacaagacctccggtaggacggccgtattcacctactctccaagacgacaaacttaccgaaagaacacgatagtactactagactaaatacgggaacacgacctaaaggagttaggaacggacgtacggtacttagtttaagtaacgtaggttaacggaaagggagggggtaactaacggagttcggacgaagtccgtaacgtaagttacttacgtttcgaacgtttccggg

SEQ ID NO: 341683 - DNA, 623 bp, Homo sapiens
  misc_feature: GZ8MTXP01ASBLK.9.33.C11.1.454.CMB.2.raw
  modified_base (270)..(270): a, c, t, g, unknown or other
  misc_feature (270)..(270): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttacaatactatacagactccgtgaaggccattcaccatctcagagacaattccaaagaacacgatgtatcngacaaatggacagcctaagagttgaggacacggtctgtttatactagtaacggaaaggagggggatacgaggtggcagcctaccaaagtacttactttgaacttcgtcggggacctaacgggaaccctggtccaccgtctaccctcacgtccctacccgaaccgaacggggcccctaacgtcccgggttcccttccccccgtgggccccgtccccttcgccctcccggacggacgcccacccgtccgagacgccgaacgcggtccggccctcggggcctcggccgttgggaccaagggtaccttaccgttccgaggttacctaactcaacgtcgacggccgggcttgggaacg

SEQ ID NO: 341684 - DNA, 568 bp, Homo sapiens
  misc_feature: GZ8MTXP01DCB0X.9.33.C11.1.454.CMB.2.raw
  modified_base (532)..(532): a, c, t, g, unknown or other
  misc_feature (532)..(532): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtgggggggggctgggtccagcctgggagtccctgagctctcctgtgcaggctctggattcaccttcagtaactacggcgtgcacgtgggtcccgcaggctccgaggcgaaggggcttggagtggctggctagttgtttcatcgtaggaaggtagtgttacaataactataacagactccgtagaacgggccattccactatctacagagaacaattaccaaagaacacgatgtatctaggacaaagtggacagaccgtaagagttagacggtacgacggtcttagtttaatacgttaggtaacggaaagggtagggggattagngttggaacagtctcgaagttactaacgttgtaaccg

SEQ ID NO: 341685 - DNA, 554 bp, Homo sapiens
  misc_feature: GZ8MTXP01ATKQK.9.33.C11.1.454.CMB.2.raw
  modified_base (520)..(520): a, c, t, g, unknown or other
  misc_feature (520)..(520): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccgaggcaagggcttggagtggctggctaggtttgttcatcgtagaaggaagtgttacaataactataacagactcgtagaacgggctatcacatctacagagacaataccaaagaacacgatgtaatctaggacaaagtggaacagaccgtaagagttagaaggacacggtcttgtttaatacgttaggtaacgaaagggtagggggaattacgngttggcagctacgagttacttaacgttgtaaccg

SEQ ID NO: 341686 - DNA, 616 bp, Homo sapiens
  misc_feature: GZ8MTXP01EYPNX.9.33.C11.1.454.CMB.2.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtcgttaaccaccagttagcctaggtaaccaacacaaacctggccaggcctcccgaggcccctnatctttgatgcatccatcagggccatggcatcccagccaggttcagtggcaggtgggtcngggacaggaacttcaactctcaccntccagcagcctagagcctgaagtattttagcttagtttattactgtactaacacttcggggtacgtagtcggcccggtccgggggtccctaccggttttccgggccccgttacggggaaaccctaaaagtttcgaaggtaacgttaaccgaaaacggtaaacttgggttacggccgttacggccttaccctaagttcttaacggttccttacttactttccctttccccggaacc

SEQ ID NO: 341687 - DNA, 610 bp, Homo sapiens
  misc_feature: GZ8MTXP01BT3DN.9.33.C11.1.454.CMB.2.raw
tcagtgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcacatctcagagacaattccaaagaacacgatgtatctgacaaatggacagcctaaaggagttgaggacacggcttgtttattactgtacgaaaggagggggatacgagtggcagcctaccaagtactactttgaacttcgtggggccaggggaaccctggtccaccgtctcctcacgccctaccgaccgaacgggcccaacgttcccgggtccttccccccgtggcccgtccccgttgcccgtaccgagggtacgccgaccgtccggagacgccaccgacgcccgggcccgtggggcctcggcccttgggtcaaacggacccttacttcccgagttaccggtaatccgaacgtggacggttcggggcgttgggaacg

SEQ ID NO: 341688 - DNA, 559 bp, Homo sapiens
  misc_feature: GZ8MTXP01BMJPK.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtggggtcccgccaggcctccgaggcaaggggcttggagtggctggctagtttgttcatcgtagaaggtagtgttacaataactataacagactccgtgaacgggcattcaccatctcagagacaacttaccaagaacacgatgtatctggactaaagtggacagcctaagagttagaggactacggtcttgtttaattacttaggtaaacggaaagggtagggggaattacgaggttggaacagcctacgagttactaacgtttgtaaccg

SEQ ID NO: 341689 - DNA, 593 bp, Homo sapiens
  misc_feature: GZ8MTXP01BNGVW.9.33.C11.1.454.CMB.2.raw
  modified_base (450)..(450): a, c, t, g, unknown or other
  misc_feature (450)..(450): n is a, c, g, or t
  modified_base (560)..(560): a, c, t, g, unknown or other
  misc_feature (560)..(560): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggctagttgtttcatctagaaggaagtgttacaatactatacagactccgtgaaggccattcaccatctccagagacaattccaaagaacacgatgtatctgacaaatggacagcctaagagttgaggacacggctgtttattactgtaacggaaaggagggggatacaggtggcagcctaccaagtactactttgaacttcgtggggccagggaaccctggtaccaccgtctcctcacgcctccaccgaacggccccagttccggtccttcccccgnggcccgtcccgtgccctccgacggcgccacccgtcgacgacgccaacgcgccgggccctcggggctcggccttgggtaccaagggtacctacgttaccgagaccgttaancgtaaccgtggacggcgggtccgttgggaaccg

SEQ ID NO: 341690 - DNA, 590 bp, Homo sapiens
  misc_feature: GZ8MTXP01ECIVO.9.33.C11.1.454.CMB.2.raw
  modified_base (273)..(273): a, c, t, g, unknown or other
  misc_feature (273)..(273): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacttnagtaactacggcgtgcactgggtccgccaggctccgagggccaaggggcttgggagtggctggctagtttgtttcagtcgtaggaacggtagtgttacaaatactaaatacaagtactcccggtaggaacgggcccgtattccaacatctccagagactaacttaccaaagaacacgatgtaatctagacgaaagtgaacagacctaagagttaggaacgtacgacgggtcttagtttaattaacgtaggttaacggaaaggagggggatacgagttggctaagactaacgaacgtacttactttcgaacgttcggg

SEQ ID NO: 341691 - DNA, 579 bp, Homo sapiens
  misc_feature: GZ8MTXP01DL5JF.9.33.C11.1.454.CMB.2.raw
  modified_base (273)..(273): a, c, t, g, unknown or other
  misc_feature (273)..(273): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (535)..(535): a, c, t, g, unknown or other
  misc_feature (535)..(535): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactgggtggagtcggtggggggggctggtccagcctgggaggtccctgagactctcctgtgcaggctctggattcaccttnagtaactacggcgtgccacgtcgggtccgccaggcctccgaggcaagggcttggagtggctggctagttgttcatcgtagaaggtatgtacaataactatcagactcgtagaacgggcctatcaccatcncaganacaataccaagaacacgatagtatcgtaggactaaagtggaacacgtacctaaagtacgttaggacggtacgtacggtcttagtttaattaacgttaggtaaacggaaagggtagggggaattacgnggttggcagtccgtacgtaacgttacgttaacgtttcgtaaccg

SEQ ID NO: 341692 - DNA, 558 bp, Homo sapiens
  misc_feature: GZ8MTXP01AHF67.9.33.C11.1.454.CMB.2.raw
  modified_base (535)..(535): a, c, t, g, unknown or other
  misc_feature (535)..(535): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccagagacaattccaaagaacacgatgtatctgcaaatggacagcctaagagttgaggacacggctgtttatactgtacgaaaggagggggatacgagtggcagcctaccaagtactacttgaacttcgtggggccaagggaacctggtcaccgtctccctcacgccctacaccgaacgggcccagtccggtccttcccccgtggcccgccctgcctccgaggacgccaccgtccgagacgccacgcgccgcccgtgggctggccttggcaacggtactaccttcgagccgtaacncgaacgtcggcggcggcgcggcg

SEQ ID NO: 341693 - DNA, 562 bp, Homo sapiens
  misc_feature: GZ8MTXP01B8AVJ.9.33.C11.1.454.CMB.2.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccacctgtctttgctccgaggggaaangccacctntcctgcagggccagtcagagtgttaacccacctagttagcctggtaccaanacaaactggccaggctcccaggcccctnatctttgatgcatccatcagggccactggcatcccagccaggttcagtgcaggtgggtctgggacngaacttcaactctcaccatcagcagcctagacgctgaagtntttgctagtttatactgtacaacattcggtacgtaggtcggccgtccggggcctacgttcggcccttagggaaccctaaattcgaagtaactacgaaacgtaacgttgtacgggtcttcggaccacccgtaattccttcgttccttacacttccgttccccgtaacg

SEQ ID NO: 341694 - DNA, 628 bp, Homo sapiens
  misc_feature: GZ8MTXP01EBWB7.9.33.C11.1.454.CMB.2.raw
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
  modified_base (524)..(524): a, c, t, g, unknown or other
  misc_feature (524)..(524): n is a, c, g, or t
  modified_base (578)..(578): a, c, t, g, unknown or other
  misc_feature (578)..(578): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccaggccgtgggaggtccctgagactctcctgtgcaggctctggattcaccttcagtaacncggctgcacgtcgggtcccncaggcctccgagggcaaggggcttgggagtggctgggctaggtttntttcatcgtgaaaggtattgtacaatactaaatacaagactccggtaggaacggggccctattccaaccctatctaccgaagaacgaacaaacttacccgaaagaacacggattagtatctagactaaagtcggaacacgacctaaaggagttggaacggtacgtaaccgggttntttagtttaacgtaacgtaggttaaacgggaaaggggttaggggtaagtacggnggttcggactaacggtctaacgtaacgttacttacgttcgttccgttcgg

SEQ ID NO: 341695 - DNA, 543 bp, Homo sapiens
  misc_feature: GZ8MTXP01E2OWP.9.33.C11.1.454.CMB.2.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (519)..(520): a, c, t, g, unknown or other
  misc_feature (519)..(520): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttaccacccagttagcctggtaccaacacaaacctggccaggctcccaggcccctcatctttgatgcatccatcagggccactggcatccccagccaggttcagtggcaggtgggtctggggacngaacttcnctctcaccatcagcagcctagacgcctgaagtatttagctagtttattactgtcaacatcggtaccgagtcgggcccgtcccgggggccctccgttccggcccgtcgggaaccaaaattgagaatacaaacgacgttgtggcttgcaccnnctcgtctcactccgttcccgtcc

SEQ ID NO: 341696 - DNA, 733 bp, Homo sapiens
  misc_feature: GZ8MTXP01DSTC1.9.33.C11.1.454.CMB.2.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgttctttgtcctccgaagggggaaancgccaccctctcctgcagggccagtcagagtcgttaccaccagttacgcctggtaccaacacaaacctggccaggcctcccgaggcccctnatcttgatgcatccatcgaggccacgtgcactcccagccgtaggttcaggtcggacgtacggtgggggtacgtacggggaacctacggtaacccttccaaccttcctacccaaccctactaccgacgaccgaaccgtacccgtaaggaccgtaccgtaaggtaaagtttagttttacggtactttaaggttttaacgttacttacgtaacctaaacgttacgttaccggggtaacggtcggggttaccgggtcccccggggttaccccgggggtacccctttaccgggtttccccgggtaccccggttaacgggtaaaaccttaaaacggtttcggaaacggtaactaaacccgaaacggtaacgttgggtaacggtcttacgccttaccgtaattccgttcgttcttacttacttccccgtttcccgtaacc

SEQ ID NO: 341697 - DNA, 634 bp, Homo sapiens
  misc_feature: GZ8MTXP01DBTDD.9.33.C11.1.454.CMB.2.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (479)..(479): a, c, t, g, unknown or other
  misc_feature (479)..(479): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccattcaccatctccaganacaattccaaagaacacgatgtatcngcaaatggacagcctaaagagttgaaggacacggtctgtttattaactggtaacgaaagggagggggatacgagtggcagcctaccaagtactacgtttgaaccttcgtcgggggcccaacggggtaaacccctgggtacctacccgtctcccgtacacgcctacccaacgaacgggcccaagttcccgggtccttcccccgtggcccnccctgcccgtcggacggacgtccgacccgtccgacgcgcgaaccgcggcccggcccgtcggggccgtcgcccggttcggtaccgaaacgggtacccttacgttacccgaggttaccgtaactacgaaccgtggacggcggggcttcgggaaccgg

SEQ ID NO: 341698 - DNA, 795 bp, Homo sapiens
  misc_feature: GZ8MTXP01A2HUE.9.33.C11.1.454.CMB.2.raw
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaaggggaaancgccaccctctcctgcagggccagtcagagtcgttaccacctagttacgcctaggtaacccaacacaaacctggccaggcctcccgacgcccctnatctttgatgcatccatcgagggcccacgtcggaccactccccgagccgtaggttccaaggtcggactaggggttcggggtacgtgggggaacctacggtaacctttccaaccttcctacccaccctactaccgaacgccgtaacgtaccccgttaaggaccggtacccgttagggtaaacgtttagtttttacggaccgtttaaggtttttaacttaacgttacgtaaccaaacgttacgtttacccggggggtaaacccggttcgggttccggggtaccccgggttcccggggggtaccccttaaccgggttttccccgggggtaaccccggttaacgggtaaaccccgtaaaagtttcggaaacggttaaactaacccgaaaacggtaaaccgttggggttaccggaccttacggttccttaaaccccgtttcgtttaccgttaacggtttacccttaccgttacctttccccgtttaaccccgtaacccg

SEQ ID NO: 341699 - DNA, 596 bp, Homo sapiens
  misc_feature: GZ8MTXP01BA4D1.9.33.C11.1.454.CMB.2.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaanacgccaccctctcctgcagggccagtcagagtcgttaccaccagttacgcctggtaaccaacacaaaccgtggccaggcctcccgaggccccctnatctttgatcgctatccatccgagggcccacgtcggaccactccccgaagcccctaggtttccaggtcggcgtaggtgggtctggggacngaacttcnctctcacatcagcagctagcgcagtaagtnttttgcttagtttattactgtacaaactgtacgggtaccgtaggtccggccggtccggggcctaccgtttcggcccgtaggtaacctaaagttcgaagtaatacgaacgaacgttgaggtcttaggccacctaagttctaacttccttcacttcccgttcccgtaacc

SEQ ID NO: 341700 - DNA, 594 bp, Homo sapiens
  misc_feature: GZ8MTXP01BI69F.9.33.C11.1.454.CMB.2.raw
  modified_base (204)..(204): a, c, t, g, unknown or other
  misc_feature (204)..(204): n is a, c, g, or t
  modified_base (285)..(285): a, c, t, g, unknown or other
  misc_feature (285)..(285): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanacgccaccctctcctgcagggccagtcagagtgttaccaccagttagcctggtaccaacacaactgcagctcccagccctnatcttgatgcatccatcgaggccagtggcatcccagcctaggttcagtggctaggtggggtctggggacagtaaccttcaactctccacatccagcacgcctagagccgtagaagttattttgacttagtttattactgtactaactattcgggtaacgtaggtcggcccggtcccgggggcctaccgtttccggacccgttacgggaaccctaaaagttgaacgtaagttaccgaaaacggtaacttggtacggtcgttcgccttaacctaatcttaacgttccttacttacttcccttcccgtaacc

SEQ ID NO: 341701 - DNA, 606 bp, Homo sapiens
  misc_feature: GZ8MTXP01DACCR.9.33.C11.1.454.CMB.2.raw
  modified_base (311)..(311): a, c, t, g, unknown or other
  misc_feature (311)..(311): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtgggggggggctggtccagccgtggggagtccctgagactctcctgtgcaggctctggattcaccttcagtaactacggcgtgcacgtcggggtcccnccaggcctcccgaggcaaggggctttgggagtgggctgggctaggtttgtttcatcgtaggaaacggtagttgttacaaatactaaatacaagacctccggtagaacgggccattccaccatctaccagacgactaaacttaccaaacgaacacgatgtatctagacaaagtggaacacgacctaaagagttaggaacggtactacggtcttagtttattaacgtgttaaacggaaagggagggggtatacgaggttgacaagctcgtaagtacttacgtttgttaacgttcggg

SEQ ID NO: 341702 - DNA, 619 bp, Homo sapiens
  misc_feature: GZ8MTXP01ES9E4.9.33.C11.1.454.CMB.2.raw
  modified_base (271)..(271): a, c, t, g, unknown or other
  misc_feature (271)..(271): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccagagacaattccaaagaacacgatgtatcngcaaatggaacagcctaaagagttgaggatacggcttgtttatactgtaacgaaaggaggggggatacgagtggcagcctacaagtactacttgaacttcgtggggccaggggaaccctggtccaccgtctcctcacgcctccaccgaacgggccctaagtccggtccttcccccgtggcccgccccttgccctccggaacgggacgccacccgtaccggaacgcgaccaacgcggcccggcccgtgggggcctcggcccgttggggtaccaaacggggtacctaccgtttaccgacgttaccggttaatccgtaacgtgggacggccggggtccgttggggaaccgg

SEQ ID NO: 341703 - DNA, 653 bp, Homo sapiens
  misc_feature: GZ8MTXP01EH386.9.33.C11.1.454.CMB.2.raw
  modified_base (273)..(273): a, c, t, g, unknown or other
  misc_feature (273)..(273): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtgggggggctggtccagccgtgggacgtccctgagactctctgtgcaggctctggacttcaccttnaagtaactacggcgtagcacgtcgggtccgccaggcctccgaggcaagggcttggagtggctggctagtttgttcatctagaagtagttgtacaattaacaatcgagtacctccggtagaacgggcctaattccacctatctaccagacgaactaaacttaccaaagaacaacgaatgttaatccttaggaacgtaaagttacgggaacctaacgacccgtaaaggtaggtttaggaacgggtacgacggttaccgttagtttaaacgtttaacgttaaggtaaacgggttaaaagggaggggggtaaagttaaccgttaggttacggaactacgtaacccgtaaccgtaacgttaacgttaaccgtttggttaacccgg

SEQ ID NO: 341704 - DNA, 608 bp, Homo sapiens
  misc_feature: GZ8MTXP01BVN6N.9.33.C11.1.454.CMB.2.raw
  modified_base (303)..(303): a, c, t, g, unknown or other
  misc_feature (303)..(303): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcgtgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtcgggtcccnccgaggctccgagggcaaggggcttgggagtcgggctgggctaggtttgtttacagtcgtaggaaaggaagttgttacaaatactaaagtacaagactccgtggaaacgggccgtattcaccctatccgtaccagacactaataccaaagaacacgatgtaatctagacaatagacacgactaagtagttagagacgtacggtcgttagtttagttaagtagttaaggtaaagggagggggaagtaacgaggttggacgaaggtacctaaccgtaaggtacttacgttaacgttaacgttccggg

SEQ ID NO: 341705 - DNA, 627 bp, Homo sapiens
  misc_feature: GZ8MTXP01AZHQ4.9.33.C11.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggggctggtccagcctgggaggtccctgagactctcctgtgcaggctctggattcaccttnagtaactacggcgtgcacgtgggtcccnccgaggcctccaggcaaggggcttgggagtggctgggctaggtttgttcatctaggaaacggtagttgttacaaatacgtaaataacaaggtaacctcccggtaggaaacggggcccgtaattccgacctactcctaccaagaacgaactaaacttacccaaacgtaaacaacgaatagtaactactagacgtaaataggaacacgaccgtaaagagttagaaggacgtacggtcttagtttattaacgtagttaaacggtaaaggaggggagtaacgagttggacaaggacctaacgtaacgtacttacgttcgttaacgttaacggg

SEQ ID NO: 341706 - DNA, 650 bp, Homo sapiens
  misc_feature: GZ8MTXP01CTKGL.9.33.C11.1.454.CMB.2.raw
  modified_base (308)..(308): a, c, t, g, unknown or other
  misc_feature (308)..(308): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtgggagtccctgagactctcctgtgcaggctcgtgtattcaccttgaagtaacacggcgtgccacgtcgggtccnccgaggcctccgaggcaagggcttggagtgcgtggctagtttgttcagtcgtaggaaggtagttgttacaaagtactaagttacaagtacccgtaccgggtagggaacgggccctaactttccgaaccctattccgacccaagaacgaacctaaacttaccgaaagtaaccacgtaattacgtaatacgtagaacgtaaagtcggaacacgtactaaaggacgttagaacggtactacggtacttagttaataacgtaaggttaacgggaaagggttagggggtaatacgagttcggacaacgtcctaacgtaaactcgttactttcgaacgttaaccgggg

SEQ ID NO: 341707 - DNA, 610 bp, Homo sapiens
  misc_feature: GZ8MTXP01ESQYO.9.33.C11.1.454.CMB.2.raw
  modified_base (205)..(205): a, c, t, g, unknown or other
  misc_feature (205)..(205): n is a, c, g, or t
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaangccaccctctcctgcagggccagtcagagtgtaccaccagttancctaggtaccaacacaaactggccaggctcccaggcccctnatcttgatgcatccatcgagggccagtggcatcccagcctaggttcaggtgctaggtgggtctaggacagtaccttcnctctacaccatcagcagcctagacgctagaagttattttacgacttagtttattacgtacgtacaactactacggggtacgtaggtccgggtcccggtcccgggggtcctacggtttccggacccgttacgggtaaacctaaagttcgaagtaactaacgaaacggtacgttaggtcggtacgttacgccttaccgtaatccgtttcgttccttacgttaccttcccgtttccccggtaacc

SEQ ID NO: 341708 - DNA, 572 bp, Homo sapiens
  misc_feature: GZ8MTXP01EQVL9.9.33.C11.1.454.CMB.2.raw
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggcgtggtccagcctgggaggtccctgagactctcctgtgcaggctctggattcaccttcagtaactacggcgtgcacgtgggtcccgccgaggcctccgaggcgaaggggcttggagtggctggctagtttgttcagtcgtagaaggtagtgttacaagtaactataacagactccggtaggaacgggccgattccactatcctaccagacgactaacttacaaagaacacgatagtatctaggactaaagtcggaacagaccgtaaagagttagaggactacggtattgttaatacgttaggtaacggaaagggaggggtanagngttcgnagctacagttacttaacgttcgtaacg

SEQ ID NO: 341709 - DNA, 532 bp, Homo sapiens
  misc_feature: GZ8MTXP01EHCVS.9.33.C11.1.454.CMB.2.raw
  modified_base (304)..(304): a, c, t, g, unknown or other
  misc_feature (304)..(304): n is a, c, g, or t
  modified_base (472)..(472): a, c, t, g, unknown or other
  misc_feature (472)..(472): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagcttggggttttcctcgttgcttcttttaagaggtgtccagtgtcaagtgcaactggtggagtcgtgggggggctggtccagcctgggagtccctgagactctcctgtgcaggctctggattcaccttcagtaactacggcgtgcacgtgggtccnccaggctccgaggcaagggcttggagtggctggctagttgtttcatcctgaaggaagtgttacaaatactaatacagactccgtagaaggggccattcacatctccagagacaattccaagaacacgatgtaatctgacaaatggacagcctaagagtgagacacggntgttattactgttagaaaggagggggattcagtggcaagctcagtaacttaacgtttaag

SEQ ID NO: 341710 - DNA, 631 bp, Homo sapiens
  misc_feature: GZ8MTXP01EUJN3.9.33.C11.1.454.CMB.2.raw
  modified_base (257)..(258): a, c, t, g, unknown or other
  misc_feature (257)..(258): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccagggaagagccaccctctcctgcaggccagtcagagtgttaccacccagtagcctgtaacccnnacacacacncncncgcgcncgcctcctactacgtacgtactactacgtacgtacgtacgacgtacgtacgtacgtaccgtaccgtaccgtacgtacgtacgtaggtccgaggtacggtacggtacggtaacggtacgtcgtactacgtacctacgactacactacacacgacgacgacgacgtacgtacgtacgtagtacgtagttagtactacgtactacgtacgtacgtacgtacgtacgtacgtaccggtaccggtaccgtaccggtaccgtaccggtaccgtaaccgtaacgtaacgttaacgtacgaacgtaacgtaacgttacgttacgttacgtaactacgtaacgtctacgttactcgttcgtcg

SEQ ID NO: 341711 - DNA, 601 bp, Homo sapiens
  misc_feature: GZ8MTXP01BW89K.9.33.C11.1.454.CMB.2.raw
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtgggagtccctgagactctcctgtgcaggctctggattccaccttcagtaacacggcgtgcacgtcgggtcccgccgaggcctcccgagggccgaaggggcttgggagtcgggctgggctaggtttgtttcattcgtaggaaacggtagttgttacaaattacctaaatacaagtacgtccggtaggaacggggcctattcaccatctaccaagagaactaacttaccaagaacacgatagtatctagacaatggacacgacctaagagtagaggacgtacggtcttagtttataacgtagttacggaaagggagggggataaggagttggcaagtacgtaacgtaagtacttacttgttaacgttcggg

SEQ ID NO: 341712 - DNA, 600 bp, Homo sapiens
  misc_feature: GZ8MTXP01BRRL8.9.33.C11.1.454.CMB.2.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcgtggtttcgtcgttagcgtctttaagaggtgtccagtgtcaagtgcaactggtggagtcgtggggggggctggtccagcctgggaggtccctgacgctctcctgtgcgngctctgtntctctctagtactacgcgtgcncgtcggcgcgacgcgcgngcgaggcgtggngtgcgtgtcgtgttgttctatgtacgaggtagtagtactaataaactactaacacgtacgtacgtacgtacggacgtactacactactactacagaacgactaactacaaacgaacaacgatatatacgtacgacaagtacgacgacgtacgtaagtagtacgacggtacgtacgtacgttagttaagttaacgttaaggtaacggaaacgggtaaagggtaacggttacgttacggttacggtaacgacgtaacgtacgtaacgttacgttaacgttaacgtaacg

SEQ ID NO: 341713 - DNA, 560 bp, Homo sapiens
  misc_feature: GZ8MTXP01BCRLA.9.33.C11.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (535)..(535): a, c, t, g, unknown or other
  misc_feature (535)..(535): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaanacgccaccctctcctgcagggccagtcagagtcgttaccaccagttagcctggtaccaacacaaactggccaggctcccagccctnatcttgatgcatccatcgagggcccacgtggcactcccagccgaggttcaggtggcaggtgggtctgggacagtaaccttcnctctcaccatcagcacgctaganctagaagtattttacgacttagtttatactgtacaactacgtacggtacggtaggtccggcccggtcccgggggcctacgttcggacccgtagggtaacctaaagtgaagtaactacaaacgacttggtcgcttcgcactntcgttctcttcttactccgttccgc

SEQ ID NO: 341714 - DNA, 573 bp, Homo sapiens
  misc_feature: GZ8MTXP01AJJZT.9.33.C11.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (372)..(372): a, c, t, g, unknown or other
  misc_feature (372)..(372): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaaccaacacaaacctggccaggctcccaggcccctnatctttgatgcatccatcagggcccagtggcatcccagcctaggttcaggtggcaggtgggtctggggacaggtaacttcnctctacaccatccagcagcctagacgcctagaagtattttcgacttaagttttatacttgtactaactacgtcggtacgaggtcggcccgtccgggggtcctacggtttccggcccgtacgggtaacctaaaagttcgaagtaactacgaaacgtacgttgtacggcttgcactaatctgtctcacttccgttcccgtaac

SEQ ID NO: 341715 - DNA, 693 bp, Homo sapiens
  misc_feature: GZ8MTXP01DN0TK.9.33.C11.1.454.CMB.2.raw
  modified_base (248)..(248): a, c, t, g, unknown or other
  misc_feature (248)..(248): n is a, c, g, or t
  modified_base (309)..(309): a, c, t, g, unknown or other
  misc_feature (309)..(309): n is a, c, g, or t
tcagtgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttacaatactatacagactccgtgaagggccgattcaccatctccaganacaattccaaagaacacgatgtatctgacaaatggacagacctaagagttgaggacacggnttgtttaattactgtaacgaaaggagggggatacgagtggcagcctaccaagtactactttgaacttcgcggggccacgggtaaccctggtccaccgtctccctcacgccctccgaaccgtaacgggacccctacgttccccgggttccctttcccccccgtcgggccccgtcccccgtcggtaccccgttacccgggaacggggaccgaccccgtaaccccgttcccggaaacggacggacccgaaacccggcgggccccgggtccccggtcggggccgttcggcccgttcggggtaccaaacgggtacccttaaccgtttacccgaggttaaccggtaactaccgtaacgtcgggacggttcggggtcgttaacgggaaccg

SEQ ID NO: 341716 - DNA, 636 bp, Homo sapiens
  misc_feature: GZ8MTXP01BXA4F.9.33.C11.1.454.CMB.2.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaancgccaccctntcctgcagggccagtcagagtcgttaccacctagttacgcctaggtaccaacacaactggccaggctccagccctnatcttgatgcatccatcgaggccacgtggacactccccgagcctaggttcaggtggcgaggtcgggtctggggacagtaaccttcaactctcacatcagcagcctagacgctagaacgttattttagacttagtttacttactagtactaaatacgtaccgggtaacggtaggttccggcccgtccgggggtcccttaccggtttccggaccccgttagggtaaaccctaaaagtttcggaaagtaacgtaaccgaaaaccggtaacgttcggtacgggtcttacggaccttacccgtaattccgttcggtttccttaccgaccgtttccccgtttcccggtaaccc

SEQ ID NO: 341717 - DNA, 561 bp, Homo sapiens
  misc_feature: GZ8MTXP01D7G5H.9.33.C11.1.454.CMB.2.raw
  modified_base (530)..(530): a, c, t, g, unknown or other
  misc_feature (530)..(530): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggaggtcggtggggggggcgtggtccgagccgtgggaggtccctgagactctcctgtgcaggctctggattcaccttcagtaactacggcgtgccacgtcgggtccgccgaggcctccgaggcgaagggcttggagtggctggctagttgttcatcgtagaaggtagtgtacaagtaactataacagtactccggtagaacgggcattcactatctacagagaactaactaccaaagaacacgtatgtatctaggacaaagtgacagaccgtaagagttacgagtacacggtcttgttaatacgttaggtaacgaaagggaggggacttagngttgcagctacagttactaacgttgtaaccg

SEQ ID NO: 341718 - DNA, 699 bp, Homo sapiens
  misc_feature: GZ8MTXP01BLWIA.9.33.C11.1.454.CMB.2.raw
  modified_base (313)..(313): a, c, t, g, unknown or other
  misc_feature (313)..(313): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtgggaggtcggtgggggggggcgtggtccagccgtgggagtccctgagactctcctgtgcaggctctggacttccaccttcagtaacacggcgtgccacgtcggggtcccnccgaggcctacccgagggaccgaaagggggtcctttagggggagtgggtcgtgggtctaggttttcgtttcagttcgtaggaaacggtaagttgttacaaattactaaattaacaagtacctccggtaggaacggggtccctaattccaacctactctaccagaacaacaaattaccaaagaacaacgaatagtaactactacgaacgtaaagtacgggaacaacggtacccgtaaaggtagttaggaacggtacgtaacggtacgtttagttttaacgttaacgttaacggttaaacgggtaaaggggaaggggggtaacttaacggaggttggacaaggtacctaaccgtaaggttaccttacgtttcgttaacgtttccgggg

SEQ ID NO: 341719 - DNA, 590 bp, Homo sapiens
  misc_feature: GZ8MTXP01AYP1D.9.33.C11.1.454.CMB.2.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (445)..(445): a, c, t, g, unknown or other
  misc_feature (445)..(445): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactcgtgaaggccattcaccatcncaganacaattccaaagaacacgatgtatcngcaaatggacagcctaagagttgaggacacggcttgtttattacgtgtaacgaaaggagggggatacgagtggcagcctacaagtactactttgaacttcgtcggggccagggaccctggtcaccgtctcctcacgccctaccgaccgaacgggccctagtccggtccttcccccgnggcccgccctaggccctccggaacggcgtccgacccgtcgacgaacgccacgcggcccggcccgtgggcctaacggccttggacttcgaaacggccttaccgttccacggaacgtactccgacgtgacggtccgggcgtaacggg

SEQ ID NO: 341720 - DNA, 545 bp, Homo sapiens
  misc_feature: GZ8MTXP01BAS0J.9.33.C11.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaaangccacctctcctgcagggccagtcagagtgttaacccacccagttagcctaggtaacccaacacaaacctggccaggctcccaggcccctnatctttgatgcatccatcagggccactggcatcccagccaggttcagtggcaggtgggtctgggacagacttcnctcncaccatcagcaagcctagagctgaagtatttgctatttatactgtacaacatcggtacgagtcggccgtccgggggcctaccgttcggccctggggaacctaaaagttgaggaatacgaaaacggaacttgtcgggcttcgcaccaactctctctcttactccgttcccgtccc

SEQ ID NO: 341721 - DNA, 584 bp, Homo sapiens
  misc_feature: GZ8MTXP01AEA60.9.33.C11.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (546)..(546): a, c, t, g, unknown or other
  misc_feature (546)..(546): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggcgtggtccagccgtgggaggtccctgagactctcctgtgcaggctctggattcaccttnagtaactacggcgtgcacgtgggtcccnccaggcctccgaggcgaaggggtcttgggagtggctggctagtttgttcatcgtaggaaggtagtgtacaaattaacctataacgagtaccgtccggtaggaacggggcctattcccacctatcctaccagacgacaataccaaagaacacgatagtatcaggacaaagtgacagacctaagagttgacgtacgacgtcttgttaatacgttaggtaaacgggaaagggtagggggtaattacgnggttcggcagctaccgaagttacttaacgttgtaaccg

SEQ ID NO: 341722 - DNA, 579 bp, Homo sapiens
  misc_feature: GZ8MTXP01EU210.9.33.C11.1.454.CMB.2.raw
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcgtgggggggggcgtggtccagccgtggggacgtccctgagactctcctgtgcaggctctggattcacttcagtaactacggcgtgcacgtcgggtccgccaggctccgaggcgaaggggcttggagtggctggctagttgttcatcgtagaaggtagtgttacaaattaactataacagacttccggaggaaacgggccgattccaccatctaccagaacgaactaaacttaccaaagaacacgatagtatctaggacaaagtcggaacagaccgtaaaggtagttagaacggtacacggtcttagtttaattacgttaggtaacgaaaggagggggattacgnggttgnagctacagttcttaacttgtaacg

SEQ ID NO: 341723 - DNA, 582 bp, Homo sapiens
  misc_feature: GZ8MTXP01ANISA.9.33.C11.1.454.CMB.2.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttaccaccagttacgcctggtaccaacacaaacctggccaggctcccagcccctnatctttgatgcatccatcgacgggccacgtcggcactccccgagccgtaggttcaggtggctaggtggggtntggggacacgtaacttcaactctcacatcagcagcctagcgctagaatntttgacttagtttatactgtacaatntcgggtacgtgtcggccgtccgggggcctacgtttccggcccttaggggtaacctaaagttcgaagtaactacgaaaacggtacttcggtcggcttcggttccaccctaattccgtcgtacttcactttcccgttaaccccgtc

SEQ ID NO: 341724 - DNA, 662 bp, Homo sapiens
  misc_feature: GZ8MTXP01BDTX8.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggctggtccagcctgggaggtccctgagactctcctgtgcaggctctggacttcaccttcagtaactacggcgtgcacgtcgggtcccgccaggcctccgaggcgaaggggcttgggagtggctggctagttgtttcatcgtagaaggtagtgttacaataactataacgagtaccgtccggtaggaacgggtccgtaacttacccacctatcctaccagaacgaactaaacttaccaaagaacaacgtatacgtatacgtagggactaaagtcggaacacgtaccgtaaagtagttaggaacggtaaccgtacgggtactttaggtttaagttaacgttagggttaaaccggaaaggggtaacggggggtaacttaacgggttaggttacgggtaaccgacggtaaccgttaaccgtaacggttaactttaaccgtttcggtaacccgg

SEQ ID NO: 341725 - DNA, 561 bp, Homo sapiens
  misc_feature: GZ8MTXP01EV7TH.9.33.C11.1.454.CMB.2.raw
  modified_base (273)..(273): a, c, t, g, unknown or other
  misc_feature (273)..(273): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaaattccaaagaacacgatgtatcngcaaaatggacagcctaaagagttgaggacacggctgtttattactgtacgaaagaggggggatacagtggcagcctccaagtactaactttgaacttctggggccagggaaaccctggtcaccgtctcctcagcncaccaacggccactcgtctcccctcgcgcccncncnccgacgacgccaccaccgacgacgacgacgacgccggcccgtcggcgtcgccgttcggtacgaaacgaacgtaacttaccgttacgacgtaactactaactgaggcgggcgcggcg

SEQ ID NO: 341726 - DNA, 548 bp, Homo sapiens
  misc_feature: GZ8MTXP01B30NR.9.33.C11.1.454.CMB.2.raw
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccagagacaattccaaagaacacgatgtatctgcaaatggacagcctaagagttgaggacacggctgtttattactagtacgaaaggagggggatacgagtggcagcctaccaagtactactttgaacttcgtggggccagggaccctggtcaccgtctccctcagccctcaccgaacgggcccatccggtcctccccnggccnccctgcctccgaggcgccacctccgagagccaacgcgccggccctgggctcggccttgggtcagggtactcttcgcgacgtaacncaacgngcgcggtcgnggcg

SEQ ID NO: 341727 - DNA, 651 bp, Homo sapiens
  misc_feature: GZ8MTXP01D80WX.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtgggtggaggtcggtgggggggggcgtgggtccaggtcccgtggggacggttccctgacgacctctcctgtgcaggtcctcgtggtacttccaccttcagtaacgtacggcgtgctacggtcgggtcccgcgaggcctccgaggcgaagggtcttggagtggctggctagtttgttcagtcgtagaaggtagttgttacaaataacctataacgagtaccgtccggtagaacgggcctattccactatcacagagaactaacttacaaagaacacgatagtatcgtaggaactaagtacggacaacgtaccgtaaaggtagttaaggacggtacgtacggtctttaggtttaacttaacgttaggtaaacggaaagggtaagggggtaattacggttggttacgggaacgtaacggtcctaaccgtaagttactttaaccgtttcgttaacccgg

SEQ ID NO: 341728 - DNA, 621 bp, Homo sapiens
  misc_feature: GZ8MTXP01APIFZ.9.33.C11.1.454.CMB.2.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (396)..(396): a, c, t, g, unknown or other
  misc_feature (396)..(396): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcggtgggggggggctggtccagccgtgggagtccctgagactctcctgtgcaggctctggattccaccttnagtaacacggcgtgcacgtcgggtcccnccgaggcctccgaggccgaaggggtcttgggagtggctggctagttgttcagtcgtaggaaacggtagtgttacaaattactaaatacgngtaccgtccggtaggaacgggccgtattccaaccatctaccaagacgaactaacttaccgaaagaacaacgatagtactactagaacgaaagtcggaacacgtaccgtaagtaggtagaggacgtacggtcttagtttataacgtaggttaacggaaagggagggggtaatacggagttcggacgaagtcctaacgtaagtacgttacgttcgttaacgttcggg

SEQ ID NO: 341729 - DNA, 664 bp, Homo sapiens
  misc_feature: GZ8MTXP01BAYPR.9.33.C11.1.454.CMB.2.raw
  modified_base (608)..(608): a, c, t, g, unknown or other
  misc_feature (608)..(608): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggcgtggtccagccgtgggaggtccctgacgactctcctgtgcaggctcgtggtacttccgaccttcagtaaccgtacggcgtgcgacgtcggggtccccgccgaggcctacccgagggacgaaacgggggtcgtttaggggacggttgggccgttagggtcctaaggttttcgtttacagttcgtacggaaagggtaagttgtttaccaaattaaacctaataacgacgacttcccggtaggaacggggccgtattcccacctactcctaccgaagaacgaactaacttaaccaaagaacacgtatacgtatctaggacaaagtgaacagaccgtaagtagtagagtacgacggtcttggttaattacgttagtaaacggaaagggagggggtanacggttgttacggaacgtacgtaacgtacgtaacgttacttaacgtttgtaaccgg

SEQ ID NO: 341730 - DNA, 606 bp, Homo sapiens
  misc_feature: GZ8MTXP01APFQY.9.33.C11.1.454.CMB.2.raw
  modified_base (296)..(296): a, c, t, g, unknown or other
  misc_feature (296)..(296): n is a, c, g, or t
  modified_base (377)..(377): a, c, t, g, unknown or other
  misc_feature (377)..(377): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaagacgcccaccctctcctgcagggccagtcagagtcgttaccaccagttagcctggtaccaacacaaacctggccaggcctcccaggcccctnatcttgatgcatccatcgagggcccacgtggcactcccagccaggttcaggtggcaggtgggtcgtgggacagtaacttcnctcctacaccatcagcacgcctagacgtctagaagtattttacgacttaagtttattaacttgtacaaactacgtacgggtaccgaggtcggcccggtccgggggtaccctccggtttacccggacccgtacgggtaaacctaaaagttcgaagtaactaacgaaacgtaacttggtcggtcttacggccaacctaagtctcgttcttacttacctccgttcccgaacc

SEQ ID NO: 341731 - DNA, 643 bp, Homo sapiens
  misc_feature: GZ8MTXP01B1VUX.9.33.C11.1.454.CMB.2.raw
  modified_base (471)..(471): a, c, t, g, unknown or other
  misc_feature (471)..(471): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttacaatactatacagactccgtgaagggccgattcaccatctccagagacaattaccaaagaacacgatgtatctgacaaatggacagacctaagagttgaggacacggcttagtttatacgtaggtaacgaaagggagggggtatacgaggtggcagcctaccgtaagtactacttgtaacttcgtggggacccagggaaccctggtccaccgtctccgtcacgccctaccgaaccgaacgggcccctacgttccggttcccttcccccgnggcccgtcccctgccctccggggaacggtacgcccaacccgtccgacgcgaccaccgacggccggtcccgtggggcctcggacccgttgggtaccaaacgggtaccttaccgttaccgacggttaccttaagtccgaacgttcggacgggccgggtaacgttcgggaacccg

SEQ ID NO: 341732 - DNA, 555 bp, Homo sapiens
  misc_feature: GZ8MTXP01ER8O5.9.33.C11.1.454.CMB.2.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcacatctccagagacaattccaagaacacgatgtatctgcaaatggacagcctaagagttgaggacacggctgtttattactgtacgaaagagggggatacagtggcagcctccaagtactactttgaacttctggggccagggaaccctggtcacgtctcctcagcctccacaggcccatcgtctccccngcnccngctccgagacgcaccgtcgagcgcacacgccggcccctgggggcctcggcccgttgggtaccaaagggacctaacttccccgagacccggttaatccaaccgttggacggcggggcttgggaaccg

SEQ ID NO: 341733 - DNA, 595 bp, Homo sapiens
  misc_feature: GZ8MTXP01DKED4.9.33.C11.1.454.CMB.2.raw
tcagtgatacgtctcacgaccggtgctcgatttagagtgagctcgttgggtttgggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtgggggggggctggtccagcctggggaggtccctgagactctcctgtgcaggctctggacttcaccttcagtaactacggcgtgcacgtgggtcccgccaggcctcgaggcaaggggcttgggagtggctgggctagtttgtttcattcgtagaaaggagtcgttacaaatactatacaagtactccgtagaaacggggtccattccacctatctaccagacgacaattaccaaagaacacgatagtatctagacaaagtaggggacagacctaaagtagtggaggactacggtcttagtttatacgtagtaacgaaagggagggggaattacgaaggtgacgcgactaacgtaacgtaacttacgttagttacttcggttcgggtaacccgg

SEQ ID NO: 341734 - DNA, 671 bp, Homo sapiens
  misc_feature: GZ8MTXP01BXLEB.9.33.C11.1.454.CMB.2.raw
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagcccacccttgttcttttgtctccgaaggggaaagacgcccaccctctcctgcagggccagtcagagtcgttaaccacctagttacgcctaggtaaccaacaaccaaacgtggccaggcctcccacggcccctnattcgtttgatcgcactccatcgagggcccatcggccacgtccccagcctaggttcaggtggcgaggttcggggtctaggggacagtaaccttcncttctaccacctatccgagctacgcctaacgacgtaccgtagtaacgttagttttacgtacgtttaagttttacttacttagttactaacgtacgttacgggtacggtacggtcgggtcccggtcccgggggtcctaccggtttccggacccggtacgggtaaacccgtaaagttcggaagtaacgtaacgttaaaccggtaacgttcggtcggacttcgccacctaagttctaacgttctacgttaccttcccgttccccgtaacc

SEQ ID NO: 341735 - DNA, 587 bp, Homo sapiens
  misc_feature: GZ8MTXP01BBUJ3.9.33.C11.1.454.CMB.2.raw
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctgattcacttnagtacacggcgtgcacgtgggtccnccaggcctccgaggcaaggggcttgggagtggctggctagttcgttnatcgtaggaacgagttgtacaatactaatacngtacctccgtagaacgggccatcacatctacaganacatacaagaacacgatgtaatctagacgaaataggaaccagtacctaaagtgttgaacggacgtacggtcttacgttaattaacgtaaggttaacggaaagggagggggtaataacggaggttcggacgaacggtactaacccgaagttacgttacgttcgttcgttaacccggg

SEQ ID NO: 341736 - DNA, 604 bp, Homo sapiens
  misc_feature: GZ8MTXP01E0L0V.9.33.C11.1.454.CMB.2.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagtgatacgtctcacgaccggtgctcgatttagagtgagctcgttggggtttggggctgggagaggagcccagcactagaagtcggcggtgtttccattcggtgatcagcactgaacacagaggactcaccatggagtttgggctgagcttggggttttcctcgttgcttcttttaagaggtgtccagtgtcaagtgcaacgtggtggaggtcggtgggggggggctggtccaggccgtgggagtccctgagactctcctgtgcgaggctcgtggtacttcgaccttnaagtaacgtacggcgtgcacgtcgggtccnccaggcctaccgagggacgaaggggtcttggggagtgggctgggctagtttgttcatccgtaggaagtagtgtacaaaatactaatacagtacctcggtagacgggcatcacatcacaganacaactcaaagacacgatntagtntagactaaagtcggaacacgacgtaaggtagtgaagtaccgaggtcttaaggttacttacggtaggttaaaggaaaggggtaagggggttattacggaggtggacaacggactaccgaagttaacgttaacggttaacg

SEQ ID NO: 341737 - DNA, 594 bp, Homo sapiens
  misc_feature: GZ8MTXP01AOBED.9.33.C11.1.454.CMB.2.raw
  modified_base (273)..(273): a, c, t, g, unknown or other
  misc_feature (273)..(273): n is a, c, g, or t
  modified_base (450)..(450): a, c, t, g, unknown or other
  misc_feature (450)..(450): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccaggcctgggacgtccctgacgactctcctgtgcaggctactggacttcaccttnagtaactacggctgcacgtgggtccgccaggcctccgaggcaagggcttgggagtggctggactagtttgttcatcgtacgaacggtagtgttacaataactactaacgagtacctccggtgaacgggtcattccaccctatccgcaagacacaacttaccaaagaccagatcgtanctagactaagacgacgacgacgtaagagtagacgtacgtacgtacgttagttaagttaacgttacggtaacggaaacgggaaggggtaagttacgacggacggaacgacgaacgtacgtaacgttacttaacgttaacgtaacg

SEQ ID NO: 341738 - DNA, 631 bp, Homo sapiens
  misc_feature: GZ8MTXP01AVXUI.9.33.C11.1.454.CMB.2.raw
  modified_base (299)..(299): a, c, t, g, unknown or other
  misc_feature (299)..(299): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattccaccttcagtaacacggcgtgcacgtgggtcccnccaggcctccgaggcgaagggtcttgggagtggctgggctaggtttgtttcatcgtgaaggaattgtacaattacctaaatacaagactcccgtagaacggggccagttcaaccactctaccaagacgaacaattacccgaaagtaacaacgatgtaatcgtagacgaaagtcggaacaacgacccgtaaagaggtttaggacggaacgtacggtactttagtttaattaaccgtacgttaaaggaaaagggttagggggtaaataacgaggttcgggaccaagggtcctaaccgtaaacggttacttacgtttcggttaaccgtttccggg

SEQ ID NO: 341739 - DNA, 591 bp, Homo sapiens
  misc_feature: GZ8MTXP01DSY72.9.33.C11.1.454.CMB.2.raw
  modified_base (424)..(424): a, c, t, g, unknown or other
  misc_feature (424)..(424): n is a, c, g, or t
  modified_base (552)..(552): a, c, t, g, unknown or other
  misc_feature (552)..(552): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggaggtcggtgggggggggcgtggtccaggccgtggggaggtccctgagactctccgtgtgcgaggcttcgtgggtacttccaccttcgaagtaaccgtacggcgtgccacgttcggggtccgccagggcctccgaggcaaaggggcttgggagtggcgtggcagtttgttcattcgtaggaaaggtagtcgttacaatactataacaagactcgtgaacgggcatcacanctcagagacaatcaaagaacacgatagtatctagactaaagtggaacgaacgtaccgtaaagtaggttagaggtacgacggtctagtttaatacgtagtaacggaaaggagggggattacgagtgacngactctaaggtcttaacttcgactccgttcgggaaccgg

SEQ ID NO: 341740 - DNA, 657 bp, Homo sapiens
  misc_feature: GZ8MTXP01C4GGT.9.33.C11.1.454.CMB.2.raw
  modified_base (298)..(298): a, c, t, g, unknown or other
  misc_feature (298)..(298): n is a, c, g, or t
  modified_base (618)..(618): a, c, t, g, unknown or other
  misc_feature (618)..(618): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaagcgcccaccctctcctgcagggccagtcagagtcgttaccaccagttacgcctggtaaccaacaacaaacctggccaggctcccacggcccctnatcttgatcgcatccatcgaggcccacgtggctactccccgagccctaggttcaggtcggcgtaggtcggggtctaggggaccagtaaccctttcaacttcctacccaaccgtatccgaagtcaacgtccctaggacgcctagtaagttatttagtacttagtttactacgtagtactaacgtacgttacgggtaaccgtacggtacgggtccccgtccgggggcccttaccggtttccgggaccccgtaggggtaaaccctaaaagtcgaacgtaactaacgaaacgtacgttaggttacgcgttacgccttaaccgtnttcttcgttccttaccttactttcccgttcccgtaaccc

SEQ ID NO: 341741 - DNA, 610 bp, Homo sapiens
  misc_feature: GZ8MTXP01CY3J8.9.33.C11.1.454.CMB.2.raw
tcagtgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggctagttgtttcatctgaaggaagtgtcaatactatacagactccgtgaaggccgattcaccatctcagagacaattaccaaagaacacgatgtatctgacaaagtgacagacctaagagttaggaggacacggcttgtttattacgtaggtaacggaaaggagggggatacgagtggcagacctacaaagtacttaactttgtaaacgttcgcggggtaccgacggggtaaacccgtggtaccacccgttctccctcacgccctaccaaccgacggcccagtccgtcctcccccgtgcccgccctgccctacgacggacgccaccgtccgacgcgccacgcgtccggcccgtgggcctcggccgttcggtcgaaacgggtacctacgttaccgacgttaccgtaatccgaacgtcgacggcgggcgttcggaacg

SEQ ID NO: 341742 - DNA, 585 bp, Homo sapiens
  misc_feature: GZ8MTXP01C6B4B.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcacgtcgggtcccgccaggctccgaggcaaggggcttggagtggctggctagttgtttcatctagaaggagttgttacaaataactataacgaagtacctcccggtaggaaacggggcccgtaattcccaccctatcctacccaagaacgaacaaacttaccaaagaaacaacgatagtatctaggacaaatgacagacctaagagttagagtacacgtctgtttaatacttagtaacgaaagggaagggggattacgagttggcgagctaccgaagttactaacgtttaacgtaaccg

SEQ ID NO: 341743 - DNA, 580 bp, Homo sapiens
  misc_feature: GZ8MTXP01BJHLA.9.33.C11.1.454.CMB.2.raw
  modified_base (543)..(543): a, c, t, g, unknown or other
  misc_feature (543)..(543): n is a, c, g, or t
tcagtgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaaggccattcaccatctcagagacaattccaaagaacacgatgtatctgcaaatggacagcctaagagttgaggacacggctgtttattactgtacgaaaggaggggggatacgagtggcagcctacaagtactactttgaacttcgtcggggccagggtaaccctggtcaccgtctccctcacgcctccgaccgaacgggcccagttccggtaccttcccccgtgggcccgccctgcctccgacggtacgccaccgtccgagacgcgacgacggcccggcccgtgggcctgcccgttgggtacaacggccttacgttccgnggacctcgcaacgtggacggcgggtcgttgggaaccg

SEQ ID NO: 341744 - DNA, 581 bp, Homo sapiens
  misc_feature: GZ8MTXP01DL86V.9.33.C11.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (447)..(447): a, c, t, g, unknown or other
  misc_feature (447)..(447): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagtgatacgtctcacgaccggtgctcgatttagagtgagctcgttggggtttgggggggcgtggtccagcctgggaggtccctgagactctcctgtgcaggctctggattcaccttcagtaactacggcgtgcactgggtccgccaggctccaggcaaggggcttggagtggctggctagttgtttcatctgaaggaagtgttcaatactatacagactcgtgaaggccattcacatcncaganacaattccaaagaacacgatgtatctagacaaatgaacagacctaagagttgaggacacggtcttgtttattactagtaacgaaaggagggggatacagtgcagcctacaagtactactttgaacttcgtcggggcacgggaaccctggtccaccgtctcctcacgcctaccacgacggcccacgtccggtccttccccgngccgccctgcctcggacggacgcccaccgccgagcgaccacgacgtccggcccgtgggctcgcccgttggtacgaaacggtaccttacttacccgagacgttaacncgtaacggnggacggcggtcgcggaacg

SEQ ID NO: 341745 - DNA, 547 bp, Homo sapiens
  misc_feature: GZ8MTXP01DZ2GI.9.33.C11.1.454.CMB.2.raw
  modified_base (244)..(244): a, c, t, g, unknown or other
  misc_feature (244)..(244): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (492)..(492): a, c, t, g, unknown or other
  misc_feature (492)..(492): n is a, c, g, or t
  modified_base (514)..(514): a, c, t, g, unknown or other
  misc_feature (514)..(514): n is a, c, g, or t
  modified_base (524)..(524): a, c, t, g, unknown or other
  misc_feature (524)..(524): n is a, c, g, or t
tcagtgatacgtctcacgaccggtgctcgatttagagtgagctcgttggggtttggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactcgtgaagggccattcaccatctcaganacaattccaaagaacacgatgtatctgacaaatggaacagcctaaagagttgaggacacggtcttgtttaattactggtaacgaaaggaggggggatacgagtggcagtcctacaagtactacttgaacttcgtcggggcacgggtaaccctgggtcacgtcncctcagcctcacgaacggcccatccggtcctcccgtgcncctgctcgaggcncacctcgagncacncgtccggcctgggctgccnggtacaacggcttacttaccgngttaaccgtntacgaacgtgcggcgtgcgaacg

SEQ ID NO: 341746 - DNA, 726 bp, Homo sapiens
  misc_feature: GZ8MTXP01A08XY.9.33.C11.1.454.CMB.2.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctcagccacctgtctttgtctccgaaggggaaancgcccaccctctcctgcagggccaagtcaagagttcgttaaccaccagttacgcctaggtaacccaaacacaaacctggaccaggcctcccaggcccctntattcttgatcgcactccatccaggggcccaacgtggccacgtccccgaagtccgtaggttccaaggtcggcgtaagggttcggggtcgtacgggggacacggtaacctttacccaacttcctaccaacccatccaaggccaaacgtcctaagacgccttaaggaaacgttattttacggacttaaggttttacttaacgtcgttaactaaacgtacgtaccggggtaaccggtaggttccgggaccccggttcccggggggaccttaccggtttccgggacccgttaacggggtaaaccttaaaagtccggtaaagtaacgttaaaccgaaaacggtaacgttcggttacgggacttcggaacccttacgtaacttcccggttcgttaccttccttaaccggtttcccttccccggtaaccg

SEQ ID NO: 341747 - DNA, 626 bp, Homo sapiens
  misc_feature: GZ8MTXP01BH549.9.33.C11.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctntcctgcagggccagtcagagtcgttacccaccagttacgcctggtaaccaacacaaacctggccaggcctcccaggcccctnatctttgatgcatccatcagggccactggcatcccagccaggttcaggtggctaggtgggtctggggacagtaaccttcaactctcaccgatcagcacgcctagacgcctaggaactattttgaccttagttttactacgtnttaccaaactacgttaccggggtaacccggtaggttccggccccggttccgggggacccctacgtttcccgggacccgttaggggtaaaccctaaaagttcgaagtaacttaacaaaacggtaccttggtacggtcttcggccttaccgtaagttcttcgttccttacttactttccccgttcccgaacc

SEQ ID NO: 341748 - DNA, 606 bp, Homo sapiens
  misc_feature: GZ8MTXP01ER2KV.9.33.C11.1.454.CMB.2.raw
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactgggtggagtcggtgggggggggctggtccagccgtggggacggtccctgagactctcctgtgcaggctctggacttcaccttcagtaacacggcgtgccacgtcgggtcccgccgaggcctccgagggcaagggggtcttgggaggtggcgtgggctaggtttgtttcatcgtaggaaaggagttgttacaaatactaatacaagtactcccggtagacgggcctatcacatctcagacaacaattaccaaagaacacgatacgtatcgtagactaaagtcggaacacgaccgtaagagttaggacggacgtaacggtcttagtttaataacgtaggttaacggaaagggagggggatacgagttcggacaagctaactaagtacttacttcgttaacgttcggg

SEQ ID NO: 341749 - DNA, 669 bp, Homo sapiens
  misc_feature: GZ8MTXP01A39XP.9.33.C11.1.454.CMB.2.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaangcccaccctctcctgcagggccagtcagtagtcgttaaccacctagttacgcctaggtaaccaacacaaaccgtggaccaggcctcccgacggcccctnacttctttgactgctatccatcgacgggccacgtcggacacgtccccagccgtaggttcaggtcggctaggttgggtctaggggacagtaaccttcaactctacacctntcagcacnctagcgacgtagaattagtttagacttagtttactacgtgttaacaactacgttacgggtacggtacggtccgggtacccgggttcccgggggtaccctccgggttttacccgggaccccgtaacgggggtaaaaccctaaaaggttcggaaacgtaaaccgttaacgaaaaccggtacgttacggtacgggccttacggaccttaccttaattcgtaacgtttcttcactttcccttcccgtaaccc

SEQ ID NO: 341750 - DNA, 620 bp, Homo sapiens
  misc_feature: GZ8MTXP01AV36N.9.33.C11.1.454.CMB.2.raw
  modified_base (302)..(302): a, c, t, g, unknown or other
  misc_feature (302)..(302): n is a, c, g, or t
  modified_base (576)..(576): a, c, t, g, unknown or other
  misc_feature (576)..(576): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaacgtggtggagtcggtggggggggctggtccagccgtggggagtccctgagctctcctgtgcaggctctggacttcaccttcagtaactacggcgtgcacgtgggtcccnccaggcctccgaggcaagggcttggagtggctggctaggtttgttcagttcgtaggaaaggtagtgttacaaataactaataacgagtaccgtcccggtaggaacgggtcccgtattcccaacctactacctacccgaagaacgactaaacttaccaaagaaccaacgatgtaatctaggaactaaagtcggaacagtaccgtaaagtagttaggagtacgacggtacttgttaattacgttaggtaaacggaaagggacgggggtattaacgnggttacggcacggtctaccgaagttacttaacgttcgtaaccgg

SEQ ID NO: 341751 - DNA, 692 bp, Homo sapiens
  misc_feature: GZ8MTXP01BRTOD.9.33.C11.1.454.CMB.2.raw
  modified_base (283)..(283): a, c, t, g, unknown or other
  misc_feature (283)..(283): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtgggggggggctggtccaggccgtgggacgtccctgagactctcctgtgcaggctctggattccaccttnagtaacacggcgtgcacgtcgggtcccgccgaggcctccgagggccgaagggggtcttgggagtggcgtgggctaggtttgttcagttcgtaggaaggtagttgttaacaaattactaaatacaaggtactccgggtaggaacgggtccgtattccgaaccctatcctaccgaagacgtaacctaaattaaccccgaaaggtaaacctacggaattagtaactacgtacggaactaaagttcggaaccacggtaaccgtaaaggtggttaggaacggtaccgtacgggtctttaaggtttaactaacggtaaggttaaacgggaaaggggagggggtaactacggttaggttcggacgtaacgtaccgtaacgtaacgttaccgttacgttcgttaaccgtttccgggg

SEQ ID NO: 341752 - DNA, 624 bp, Homo sapiens
  misc_feature: GZ8MTXP01ARG30.9.33.C11.1.454.CMB.2.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtcgttaccaccagttacgcctggtaacccaacaccaaacctggccaggcctcccaggccccctnatctttgatgcactccatcgacgggccacgtggccactcccagccaggttcagtggcaggtgggtctgggacagtaacttcaactctcacatcagcacgctagacgctagaagtatttcgacttaagtttattactcgtactaactacgtaccgggtacggtacggtcggaccccggtccgggggtccctaccggtttcccggtacccgtacggggtaaaccctaaaagttcgaagtaacgtaaccgaaacggtaaacgttggttacggcgttcggccaccgtaacttccgtcgttccttccttaccttcccgtttccccgtaacc

SEQ ID NO: 341753 - DNA, 595 bp, Homo sapiens
  misc_feature: GZ8MTXP01A8QZW.9.33.C11.1.454.CMB.2.raw
  modified_base (302)..(302): a, c, t, g, unknown or other
  misc_feature (302)..(302): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagccgtgggagtccctgagactctcctgtgcaggctctggacttcaccttcagtaactcggctgcacgtcgggtccncaggctccgaggcaagggcttgggagtcgggctggctagtttgtttcattccgtaggtaaaggtagtgttacaaagttactaatacagacttacccgtaggaacgggcctagttaccacctactactccaaggacgtaactaacttaccaaagaacacgaatagtactcgtagactaagtacggacagacctaagagtgaggtacgacggtctaagtttagttacgtaggttaacggaaagggtaggggacttagacggtggacgaagctacgagttaaccgttcgtttaacg

SEQ ID NO: 341754 - DNA, 668 bp, Homo sapiens
  misc_feature: GZ8MTXP01DJANA.9.33.C11.1.454.CMB.2.raw
  modified_base (333)..(333): a, c, t, g, unknown or other
  misc_feature (333)..(333): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtgggaggtcggtggggggggctggtccaggccgtggggacggtcccctgacgtactcgtccctggtcgcgagggtcctcgtggtacttccaccttcaagtaacgtacggcgtgcctacgtcgggtccnccgaggctaccgaggcgaagggtcgttgggagtggcgtggcgttagtttgttcatccgtagaaaggtattgtacaaaattactaagtacacgtacgtaccggtagacgggtctacttccactactcctacgaagaacaaacgtaacttaccaaagaaccaacgtattacgtacttacggtagaacctaaagtcggaacacgtaccgtaaagtacgtacgaggtaacgacggttcttaagtttaacgttacgtaaggttaaacgggaaagggtaggggttaagttacggttaggtcggacgtaacgacctacgttaagtccgttaacgtttaacgg

SEQ ID NO: 341755 - DNA, 722 bp, Homo sapiens
  misc_feature: GZ8MTXP01BV3DN.9.33.C11.1.454.CMB.2.raw
  modified_base (302)..(302): a, c, t, g, unknown or other
  misc_feature (302)..(302): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctctttaagaggtgtccagtgtcaagtgcaacgtggtggaggtcggtggggggggctggtccaggccgtgggagtccctgagactctcctgtgcaggctctggattccaccttcagtaactacggcgtgcacgtgggtcccncgaggcctccgaggcgaaggggcttgggagtggctggctaggtttgttcatcgtaggaacggtaagttgttacaattaaactaattaacgaggaccgttcccggtagggaacggggtcccgtattacccgacctatcctaccgaagaacggaactaaacgttaccgaaacgtaaacgaaccgtagttacggtattaccgtagggaaacctaaagtagggaacctaacggtaacccgtaaaggtaggttacgggtaaacggtaacggtaccggttactttggttttaaacgttaaccgttaggggttaaacggaaaagggggtaacggggggtaattaaccgggttagggttacgggtaaccgaaggtaacccgttaacccgtaaaggttaacccgttttaacggtttccggttaacccgg

SEQ ID NO: 341756 - DNA, 671 bp, Homo sapiens
  misc_feature: GZ8MTXP01ATAFW.9.33.C11.1.454.CMB.2.raw
  modified_base (365)..(365): a, c, t, g, unknown or other
  misc_feature (365)..(365): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccaggccgtggggacggtccctgacgactctccgtgtgcaggctctggattccaccttcgaagtaacctacggcgtcgcacgtgggtcccgccgaggcctccgagggcaaggggtcttgggagtggctgggctaggtttnttcagttcgtaggaaaggtagttgtacaaatactaaatacaagtacctccggaggaacgggtcctattccaacctactctaccgaagaacgaactaaacttaaacccgaaaactacgtaatagttactacgtagaaccgtaaaggtacgggaacctaagtaaccggtaaagtagttacggaacggaacgtacggttcttagtttaactaacggtaaggtaaacggaaaggggaggggttactaaggtaggcggcacggtcctacgtaacgtttaccgtacgttacgtaacgtttcgggaaccgggg

SEQ ID NO: 341757 - DNA, 539 bp, Homo sapiens
  misc_feature: GZ8MTXP01EDXY6.9.33.C11.1.454.CMB.2.raw
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtgggtcccgccaggcctccgaggcaaggggcttggagtggctggcagttgtttcatctgaaggtaagtgttcaataactataacagactccgtagaagggccattcaccatctccagagacaaattccaaagaacacgatgtatctaggcaaatggacagacctaagagtagaggacacggctgttaattacttgtaacgaaaggagggggaanacgngttggcagctccaagttactaacgtttgtaacg

SEQ ID NO: 341758 - DNA, 606 bp, Homo sapiens
  misc_feature: GZ8MTXP01DT17I.9.33.C11.1.454.CMB.2.raw
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggtttttcctcgttgcttcttttaagaggtgtccagtgtcaagtgcaacgtggtggagtcggtggggggggctggtccagccgtggggacgtccctgagactctcctgtgcgaggctctggtacttctaccttcaagtaactacggcgtgcacgtcgggtccnccaggcctccgaggcgaagggtcttgggagtggcttggcttagtttcgttacagttacgtaggaaggtagttgttacaaagttaaactataacgagtacgtcggtagaacgggcctatcactactctacaganacaatacaagtacagtatagtatctagggaactaaagtagaacgagtaaccgtaagagttacggaacgtacgtacgtacttgttaactaagttaggtaaacgaaagggtagggggattagagttagaacgtagcttactaagttacttaacgtttcgtaaccg

SEQ ID NO: 341759 - DNA, 666 bp, Homo sapiens
  misc_feature: GZ8MTXP01B1BCE.9.33.C11.1.454.CMB.2.raw
  modified_base (291)..(291): a, c, t, g, unknown or other
  misc_feature (291)..(291): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagagccaccctctcctgcagggccagtcagagtgttaccaccagttagcctggtaccaacacaaacctggccaggctcccaggcccctnatctttgatgcatccatcgagggccacgtggcactccccgagccgtaggttcaggtcggcgtaggtggggtcgtggggaccaggtaaccttcgaacttcctacccgacctactccgacgcacgtaccctaagacgtccgtaggtaaacgtttagtttttacggactttaagttttaacttacttacgttaccaaactacgttaccggggtaccggtacgggttccgggtccccgggttcccgggggtcccttaccggtttccgggtaccccgtacggggtaaacctaaagttcggaacgtaactaaccgaaacgtacgttcggtaggccttacgcacctaattcctcgttccttcacctttcccgttccccgtcc

SEQ ID NO: 341760 - DNA, 694 bp, Homo sapiens
  misc_feature: GZ8MTXP01ASR6W.9.33.C11.1.454.CMB.2.raw
tcagtgatacgtctcacgaccggtgctcgatttagagtgagctcgttgggtttggggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtggggggggctggtccagccgtgggaggtccctgagactctcctggtgcgaggctcgtgtacttcaccttgacgtaacgtacggcgtgctacgtcgggtcccgccacggtcctccgaggcgtaagggggtccttagggacgtcgggcgtggccgtaggtttcgttacagttcgtaggaaacggtagtcgttacaaagttactaaatacgaagtaccgtaccgggtagaacgggcctattaccgacctacgtcctaccgaagtacgtaacctaaacttaccgaaataaaccgagacgttagacctagtacgaacgtaaagtacggaacgacgtaaccgtaaggtagttacgggaacgaccgtacggttcttagttttaacgtaacgtaagggttaaacggaaaggggttgggggtaaactacggaggttcgacgtcgtaccgtaaccgtaagttaccttacgtttcgaaccggttccgggg

SEQ ID NO: 341761 - DNA, 570 bp, Homo sapiens
  misc_feature: GZ8MTXP01B0XB3.9.33.C11.1.454.CMB.2.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (534)..(534): a, c, t, g, unknown or other
  misc_feature (534)..(534): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctcnggtacttcaccttcagtaactacggcgtgcacgtggccnccaggctccaggcaagggcttggagtggctggctagttgttcatcgtagaaggtagtgttacaatacataacgagtactccgtagaacggggcctaattccacatctacagaacgactaaacttaccaaagaacacgtatagtatctagggacaaagtggaacagtacctaaggagttagaggtacacgtacttgtttaactacgttaggtaacggttaaagggagggggtaattacgngttaggctagctactagttacttaacgttgtaaccg

SEQ ID NO: 341762 - DNA, 646 bp, Homo sapiens
  misc_feature: GZ8MTXP01EM95S.9.33.C11.1.454.CMB.2.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtggggggggctggtccagccgtgggagtccctgacgactctcctgtgcagctntgattcaccttnagtacacggcgtgcacgtgggtccgacacggctccgaggtccgaaggggtcttagggagtgggctcgggactaggttttgtttacaagttcgtaggaaaaggtagttagttacaaatactaaataacgaagaccgtccgggtacgaaacggggtccctaattccgaactactctaccgaagacaacaagttacccaaagtaaccagatgtatactagacgtaaagtggaacagtaccgtaaagaggtttagaacggaactacgggtactttgtttaagtaacgtaggttaacggaaagggacgggggataacggagttcggacgcgggtacctaaccgaagttaccttacgttaacgttaacgttcggg

SEQ ID NO: 341763 - DNA, 707 bp, Homo sapiens
  misc_feature: GZ8MTXP01COQU9.9.33.C11.1.454.CMB.2.raw
  modified_base (312)..(312): a, c, t, g, unknown or other
  misc_feature (312)..(312): n is a, c, g, or t
  modified_base (506)..(506): a, c, t, g, unknown or other
  misc_feature (506)..(506): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtggggacggtccctgagactctcctgtgcaggctcgtggattcaccttcagtaactacggcgtgccacgtcgggtccnccgaggcctccgaggcgaagggcttgggagttgggcgtggctagtttcgtttcattccgttaggaaggtaagttggttacaaaagttacctaagtactaagtacctccgggtaggaacggggccctaagtttaccacctactctaccaagaacgaactaaacgttaccaaagtaacacgtatagtactcggtanaacgaaagtacggaacacgtaaccgttaaaggtacggttaggaacgggtaacctacgggttaccgtttaaggttttaacgttaccgggttaaaggttaaacggtaaaaagggggtaagggggttaacttaaccggttagggtaacgggaccaagggtaaccctacggttaaacggtttaacctttaaccgttttaaccggg

SEQ ID NO: 341764 - DNA, 710 bp, Homo sapiens
  misc_feature: GZ8MTXP01ECZ6U.9.33.C11.1.454.CMB.2.raw
  modified_base (256)..(256): a, c, t, g, unknown or other
  misc_feature (256)..(256): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtgggggggggctggtccagccgtgggacgtcctgagctctcctgtgcnggctcgtggattccaccttcaacgtaacgacggcgtgcacgtcgggtcccgcaggctccgaggtccgaagggtcttgggagtggcgtggtctaggtttcttcatcgtacggaaaggtagttgtacaaagttaactataaccgagtaccgtcggtaggaacgggtccctaagttcccactactccgtaaccgagaacgaaactaaacgtacccaaagaacccagtaatacgtaacttccgtaaggaacgtaaacgtagaacccgaaaggtaacccttaaagggtaagtttaacggggaacgtaacccggtaacggttaccgttttaagtttaaacgttaacggttaagggtaaaaccgggggaaaaggggtaagggggtaaccttaacggaggttacccggaagtacgtaacccgtaacgtaaacggttaactttaaccggtttcgtaacccggg

SEQ ID NO: 341765 - DNA, 599 bp, Homo sapiens
  misc_feature: GZ8MTXP01AE8P1.9.33.C11.1.454.CMB.2.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (381)..(381): a, c, t, g, unknown or other
  misc_feature (381)..(381): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaaggggaaancgccaccctctcctgcagggccagtcagagtcgttaccaccagttacgcctggtaaccaacacaaacctggccaggcctcccaggcccctnatcttgatgcatccatcgagggccagtggcatcccagccaggttcaggtggcaggtgggctggggacagtaacttcaactctcacntcagcagcctagacgcctagtaagtatttagtaccccttagtttacttacttcgtactaactacgtacgggtacgtacggtcggtcccggtcccggggtccgtacgttccggtcccgtacgggtaacctaaagttacgaacgtaacgtaacgaaacgtaaacgttggtacggtcgttcgcactaatcgtaacgttcttcttacttccttcccgtaacc

SEQ ID NO: 341766 - DNA, 714 bp, Homo sapiens
  misc_feature: GZ8MTXP01B4LOR.9.33.C11.1.454.CMB.2.raw
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtggggggggctggtccagccgtgggaggtccctgagctctcctgtgcaggctcgtggattcaccttnaagtaactcggcgtgcacgtcgggtccccncgaggcctaccgaggcgaaggggtcttgggagtcgggctgggctagtttgttcagtccgtaggaaggagttgttacaaaattactaataacaaggaccgtccggtagggaacggggtccgtaacttcccaacctactcctaccaaagacgtaaacctaaacttacccaaaggaaccaacgtattacgtactacggtacgaacctaaaagtcgggaaacacggtaacccgttaaaggtaacggttacggaaagggtacccgtacggggttcctttaaaggtttttaacgttaacggttacgggttaaaacgggaaaagggggtaggggggttaaacttacggagggttcggaccgtaagtcccgttaacgttaaacggtttaaccgtttaacgttttaaccggg

SEQ ID NO: 341767 - DNA, 664 bp, Homo sapiens
  misc_feature: GZ8MTXP01EXLTD.9.33.C11.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (403)..(403): a, c, t, g, unknown or other
  misc_feature (403)..(403): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccgaggggaaagngccaccctcncctgcagggccagtcagagtcgttaccaccagttacgcctaggtaccaaacacaaaccgtggccaggctcccgaggcccctcatctttgatgcatccagtcacgggcactggcacgtcccagccctaggttcagttcgggctaggttggggtcaggggtacagaaactttccgaactcctacacctacncacgcacgaccgtacgacgtacgtagtaagttagtttacgtaacttaagttttaacttacgttacgttaacgtaacgtacgtaccggggtaccgtacgggtccgggtcccgggttacccgggggtacccgttacccggtttacccgggtacccggtaccgggtaaaccgtaaacgtacggaacgtaacgtaaacgttaaaccgtaacgttaggtacgtgacgcttaccgtaactcttctcttcttacctcccgttccgtcc

SEQ ID NO: 341768 - DNA, 603 bp, Homo sapiens
  misc_feature: GZ8MTXP01DXETO.9.33.C11.1.454.CMB.2.raw
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (564)..(564): a, c, t, g, unknown or other
  misc_feature (564)..(564): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggggggctggtccagcctgggagtccctgagactctcctgtgcaggctctggattcaccttcagtaacacggcgtgcaactggggtcccncaggcncagcgaggcgtgagnggctgngtagttgttctatntagaacggaagtgttactaataactaaataacaagacgtacgtaggaacgggacgactacaccactactacagagaacaactaaccaaacgaaacaacgaagtatatactagacgaaagtaaggacgaagaaccgtaaagtaaggtaggaaggacgtatagtcgttgtttaagttaacgttagtaaaggaaagggaaagggggtaaggttaacgaggttacgggngacgaactactaacgttacgttaacgtttaacgttaacg

SEQ ID NO: 341769 - DNA, 711 bp, Homo sapiens
  misc_feature: GZ8MTXP01AT367.9.33.C11.1.454.CMB.2.raw
  modified_base (316)..(316): a, c, t, g, unknown or other
  misc_feature (316)..(316): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtgcaacgtggtggagtcggtggggggggctggtccaggccgtggggacgtccctgacgtactctcctgtgcaggctctggacttccgaccttcagtaactacgggcgttagccacgtcgggtcccnccgaggcctccgaggcgaaggggtcttagggagtcggacgtggctagtttgttcagttctacggaaaggtagtgttacaaattaacgtataacgacgtaccgtccggtaggaaacgggtccgtaatttcccaaccctagtcctaccaaggtacgaactaaacgttacccgaaaagtaacccgaagtaacttggtaacttaccgtaggggtaacctaaaggttcggaaccgtacgtaacccgtaaaggtaccggtttaaggaacggtaccgtaaccgggttcttagttttaacgtaaccgttagggttaaaccgaaagggggtagggggtaacttaccggaggttgggaacctaggtccgtaacccgtaggttaaccttcgtttaagtaacccggg

SEQ ID NO: 341770 - DNA, 685 bp, Homo sapiens
  misc_feature: GZ8MTXP01B57GP.9.33.C11.1.454.CMB.2.raw
  modified_base (499)..(499): a, c, t, g, unknown or other
  misc_feature (499)..(499): n is a, c, g, or t
tcagtgatacgtctcacgaccggtgctcgatttagagtgagctcgttggggtttgggggcgtggtccagcctggggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctcagagacaattccaaagaacacgatgtatctgacaaatggacagacctaagagttgaggacacggtcttagtttattacgtagtaacggaaagggaggggggatacgagtggcagcctacctaagtacttactttgtaaaccttcggtcgggggtaccgaacggggtaacccgttcgggtcctaacccggttctaccctcgacgtcccctaccacccggaacggggcccctacgttccccgggttccctttcccccgngggtcccgtccctcgtccctccggggtacggaacgccccgaccgtacccggagaccgaccgtaacgcgggtcccggcccggtcgggcgtcggcccgttgggtaaccgttaacgggaccttaccgttaccgacgttaaccgttaactacgtaaccgttaggcgggttccgggtcgttaagggaaccg

SEQ ID NO: 341771 - DNA, 847 bp, Homo sapiens
  misc_feature: GZ8MTXP01C2PMO.9.33.C11.1.454.CMB.2.raw
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgttctttgtctccgaaggggaaagacgccaccctctcctgcagggccagtcagtacgtcgttaccacctagttacgcctaggtaaccaacaacaaaccgtggccacggcctacccgacggtcccctctacttctttgatcgacactccatcgacgggcctacgtcggccactccccgagccgtaggttcgaggtcggcgtagggttcggggtcgtacgggggaactacggtaacccttccaaccttcctacccaacctacgtaccgaacgggtacctaaccggtacccgttaaggaccggtacccgttaaggtaaaccggttttagtttttacgtaaccgtttaaaggtttttaactttaacgttacgttaaaccctaaaacgttaccggttaaccgggggttaacccggtaacggggtttcccggggtcccccggggttaccccgggggggtaccccttaaccccggttttcccgggggtaacccccggtttaacgggggtaaaaccccttaaaaagggttaccggaaaacggttaaaccgttaaaccggttaaaaaccgggtaacggttcgggttacggggacctttacggaccttaacccttaacgtttccgttaacggttttcctttaccggtttaccccttcccggttcctttaaccgg

SEQ ID NO: 341772 - DNA, 562 bp, Homo sapiens
  misc_feature: GZ8MTXP01BOOCJ.9.33.C11.1.454.CMB.2.raw
  modified_base (527)..(527): a, c, t, g, unknown or other
  misc_feature (527)..(527): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggctggtccagcctggggacggtccctgagactctcctgtgcaggctctggattcaccttcagtaactacggcgtgcacgtcgggtcccgccgaggcctcccgaggcaaggggcttgggagtggctggctagtttgttcatcgtagaaggtagtgttacaataactatcagtacctccggtgaagggcctattcccaccatccacagagacaactaccaaagaacaacgatgtatactagggacaaagtgacacgacctaagagttagaggacacggtctgttaatacgttagacggaaaggagggggattacgngttggaacagctactagttacttaacgttgtaacg

SEQ ID NO: 341773 - DNA, 616 bp, Homo sapiens
  misc_feature: GZ8MTXP01B1ZRE.9.33.C11.1.454.CMB.2.raw
  modified_base (172)..(172): a, c, t, g, unknown or other
  misc_feature (172)..(172): n is a, c, g, or t
  modified_base (518)..(518): a, c, t, g, unknown or other
  misc_feature (518)..(518): n is a, c, g, or t
  modified_base (565)..(565): a, c, t, g, unknown or other
  misc_feature (565)..(565): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgcttcttttaagnggtgtccagtgtcaagtgcaactggtggagtcgtggggggggctggtccagcctgggagtccctgagactctcctgtgcaggctctggacttcacttcagtactacggcgtgcacgtgggtccgccaggcctccgaggcaaggggtcttgggagtcggcttgggctaggtttcgtttcagttctaggaaggtaagttgtacaataacgtataacagaccttcccggtagaaacggggccctattccaaccatcctaccagacgaactaacttaccaaagaacaacgatagtatcgtaggactaaagtacggacaagccctaaggagtttaggaggtacgacgggtnttagttaacgttacttaggtaaacggaaaggtaagggggacttacgnggttacggaacgacggtaacctacgtacgttacgttaactttgttaacccg

SEQ ID NO: 341774 - DNA, 704 bp, Homo sapiens
  misc_feature: GZ8MTXP01DOKB0.9.33.C11.1.454.CMB.2.raw
  modified_base (301)..(301): a, c, t, g, unknown or other
  misc_feature (301)..(301): n is a, c, g, or t
  modified_base (667)..(667): a, c, t, g, unknown or other
  misc_feature (667)..(667): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccacggagagattgtgttgacacagtctccagccaccctgttctttggtctccgaaggggaaagcgccaccctctcctgcgagggccagtcagagttcgttaccacctagttacgcctaggtaaccaacaacaacctggccaggcctcccaggcccctntatctttgatgctagtccatccgaggggcccaagtggacctacgtcccgagccgtaggtttccaggtcggactaggggttcggggtacgtacggggactacggtaaccctttacaaccttctaccaacctaagccgaacgcgaacggcccttaaagggactaccgtaggtaaagtttcgttttaaggctttaaaggttttactacgttagttacgaaacttccgttacggggttaaaccggtgggttaccgggtccccggttccgggggccccttacgtttccggaacccgttagggtaaaaccctaaagttcgaaagtaactaacgaaacggtaacttgggttaacgcgttacgccttaaccttntttcgtcgttctaccttaccttcccgttaacccgtcg

SEQ ID NO: 341775 - DNA, 670 bp, Homo sapiens
  misc_feature: GZ8MTXP01CJC40.9.33.C11.1.454.CMB.2.raw
  modified_base (379)..(379): a, c, t, g, unknown or other
  misc_feature (379)..(379): n is a, c, g, or t
  modified_base (623)..(623): a, c, t, g, unknown or other
  misc_feature (623)..(623): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagtcttgggttttcctcgttgcttcttttaagaggtgtccagtgtcaagtgcaacgtgggtggaggtcggtggggggggctcggtccgaggccgtggggacggtccctggacgtactctccgtgtgcaggtctctggtattcaccttcaagtaacgtacggcgtgccgtacgtcgggtcccgccgaggcctaccgaggacgaaggggtcttagggagtcggacgtgggcttaggtttntttaccagttcgtaggaaacggtagttgttacaattaactaataacgagtaccgtacggtaggaacggtccgtatacccactatcctacaagaacaactaacttaccaaagacaacgtatagtactactagaactaaagtacgaacgacgtacctaaggtaggttacggacggtaaaccgtaggttaccttaggtttaacttacggttaaggtaaacgggaaaggggtaaggggtattaacggngttacggaacacgtaactaccgtaagttaccttggtttcgtaaccgg

SEQ ID NO: 341776 - DNA, 673 bp, Homo sapiens
  misc_feature: GZ8MTXP01A2PCP.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcgtggggggggctggtccagccgtgggacggtccctgagactctcctgtgcaggctcgtggtacttcgaccttcagtaacgtacggcgtgacacgtcgggcccgcaggcctaccgaggtcaaggggtcttgggagtggctggctagtttgttcagtctaggaaggtagtgtacaaagtaactaataacgagacgtccggtaggaacgggcctattccacctatcctaccgaagacgaactaaacgttacaaacgaacaacgtaatgtaacttaccggtaacgaacgtaaagtacggaacgtaacggtaaccgtaaaggtaggttacggaacggtaccgtacggttacgtttaaggtttaacgttaacggttaaagggtaaacgggttaaaggggtaacgggggtaattacggttaggacggaacgtacgtaaccgtaacgtaacgttacgtttaacgttaacggtaaccg

SEQ ID NO: 341777 - DNA, 810 bp, Homo sapiens
  misc_feature: GZ8MTXP01CZO1O.9.33.C11.1.454.CMB.2.raw
  modified_base (264)..(264): a, c, t, g, unknown or other
  misc_feature (264)..(264): n is a, c, g, or t
  modified_base (308)..(308): a, c, t, g, unknown or other
  misc_feature (308)..(308): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtggggggggctggtccaggccgtggggagtccctgagacctctctgtgcnggctctgacttcacttcagtaacacggcgtgcacgtcgggtccnccgaggcctaccgaggcgaaggggtcttaggagtggctgggctaggtttgttcaagtctaggaaaggtagtttgttacaaattacgtaaactacgaagtacgtaccggtaggtaaacgggcctacttaccaacctacgtctacccgaagaacgaacctaaacgttaccgaaacgtaaacctacgtaattacgtaactaccgttacggaaacctaaaagtacgggggtaaaccaacgggtaaccccgtaaaagggtaacggtttagggaaaacggggtacccgttaaacggggttacccttttagggtttttaaaccggtttaaaccggttaaacgggggttaaacggggtaaaaacggggggttaacggggggggttaaattaaccgggttaaaccgggggtttgggttaaccggaaaccggtttaccccgtaaccggtttaaaacggtttacccgttttaaccggttttaaccggttaaccgggtttttaaccccgggggg

SEQ ID NO: 341778 - DNA, 554 bp, Homo sapiens
  misc_feature: GZ8MTXP01E28PF.9.33.C11.1.454.CMB.2.raw
  modified_base (204)..(204): a, c, t, g, unknown or other
  misc_feature (204)..(204): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaaggggaaanagcccaccctctcctgcagggccagtcagagtgttaaccaccagttagcctggtaccaaacacaaactgccaggctcccagccctcatcttgatgcatccatcagggccactggcatcccagccaggttcagtgcagtgggntgggacagaacttcaactcncaccatcagcagcctagagcctgaagattttgctagtttattacttgtacaanatcgggtaacgnggtcggccgtccgggggcctacgttcggtccgtacggtaaaccgaaaatagaagaagtaacgaaacgaaacttagtaggtcgcgcacctaactactcgttcttcttactccgttcccgtcccg

SEQ ID NO: 341779 - DNA, 734 bp, Homo sapiens
  misc_feature: GZ8MTXP01CU5Z1.9.33.C11.1.454.CMB.2.raw
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctctgtgcnggctctggattcacttnagtacncgcgtgcacgtgggtccgccaggcctccgagggctaaggggctttgggagtcgggctgggactaggtttgtttcagttcgtgtaaacgggtaagttgttcaaattacctaaataaccgaaggaaccttcccgggtagggtaaacgggtcccgtaacgtttccaacccgtattccctaccgaagtacgaactaaacttaccgaaaacgaacaaccgagttacgtaactacgttacgaacggtaaagtaggaaaccgacgtaccgtaaaggtacggttaaggaacgggaccgtaacgggtactttacggttttaaccgttaacggttaaggttaaccgggtaaaaggggttaacggggggtaaacgttaacgggttacgggttcgggacggtaacggtaacccgttaacccgtaaacggttacctttaaccggttttaacgaacccggttttaaccgggg

SEQ ID NO: 341780 - DNA, 794 bp, Homo sapiens
  misc_feature: GZ8MTXP01AW5X5.9.33.C11.1.454.CMB.2.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtggggggggctggtccagccgtgggacgtccctgagtactctcctgtgcaggctctgacttcaccttnagtaacacggctgctacgtcgggtccncgagctacgaggacgtaaggggcttggggagtggtcgtacggtcgttaggttttcgtttacgattccgtaaggtaaaaggtagtttgttaactaaaacttacttaaaacgtaacaagggtaaccctcgggttagggaaaccggggtcctaacttccaaaccctatcccgtaccgaagacgtaaactaacgttaaccgaaacggaaactacggaattagttaactcgttaacggaacaaaacgtagggaaacctaacggtaaacccgttaaggtacgggtttaggaaaacgggtaccgttaaccgggtaacgttttaacggttttaaaggttaaaccgtaaggggttaaaaccggggaaaaaggggggttaagggggttaaaccgacggggttaaaggttccgggaccgtaaacgttacccgttaaaccgtaaacggtttaacccctttagggtttaacccggttaaccgttttaaccccgggggg

SEQ ID NO: 341781 - DNA, 621 bp, Homo sapiens
  misc_feature: GZ8MTXP01A3OKV.9.33.C11.1.454.CMB.2.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggattccacctttnaagtaactcggcgtncacgtgggccnccagggctccgaggcctaaggggcctttggagtcggggntcggactgtttgttcagtcgtaggaaggtagttctanaatactactacaacgtacgtcggagaacggtcctatccactctcctacgagacaactaactacaaagaacagtatacgtactcgtagtactaagtacgggaacaacgtccgtaaagagtgacgtacgacgttacttagttaacgtacgtaggtaaacgggaaagggaggggtaacttaccggtaggtcggacgttcgttacgtaacgtaacgtaacgttacgttcgttacgttcggttaaccggggaaccg

SEQ ID NO: 341782 - DNA, 531 bp, Homo sapiens
  misc_feature: GZ8MTXP02FY1P3.9.33.C11.1.454.CMB.2.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtcttgtctccaggggaaagagccaccctctcctgcagggccagtcagagtgttaccacccagttagcctggtaccaacacaaacctggccaggctcccaggcccctnatctttgatgcatccatcaggccactggcatcccagccaggttcagtggcagtgggtctggggacagacttcnctctcaccatcagcagcctagagcctgaagtattttgctagtttattactagtacaaacatcgtaaccgagtcggccgtccgggggccctacgtttccggccctagggaccaaaagttgagactacaaacgactagtcggctgcaccaatctgtctcactcttcccgac

SEQ ID NO: 341783 - DNA, 527 bp, Homo sapiens
  misc_feature: GZ8MTXP02F09LK.9.33.C11.1.454.CMB.2.raw
  modified_base (297)..(297): a, c, t, g, unknown or other
  misc_feature (297)..(297): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccnccaggcctccaggcaagggcttggagtggctggctagttgttcatctgaaggagtgttacaatactatacagactccgtgaagggccattcacatctcagagacatccaagaacacgatgtatctgacaaataggacagacctaagagttagaggacacggtctagtttattacgtagtaacggaaaggagggggatacgagtaggcgagctacagtactacttagtacg

SEQ ID NO: 341784 - DNA, 533 bp, Homo sapiens
  misc_feature: GZ8MTXP02HRJZA.9.33.C11.1.454.CMB.2.raw
  modified_base (296)..(296): a, c, t, g, unknown or other
  misc_feature (296)..(296): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccnccaggctccgaggcaagggcttggagtggctggcagttgttcatctgaagagtgtcaatacatcagactccgtagaagggccattcaccatctccagagacaattaccaaagaacacgatagtatctagacaaatggacagaccgtaagagttagaggacacggctagtttatactagtaacgaaaggagggggatacgagtggaacgaggactaccgaagtactactttacgtacg

SEQ ID NO: 341785 - DNA, 509 bp, Homo sapiens
  misc_feature: GZ8MTXP02F86D3.9.33.C11.1.454.CMB.2.raw
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaaagagggggatacagtggcagcctcaagtactacttgacttctggggccagggaaccctggtcaccgtctcctcagcctccacaggcccatcgtctcccctgcncctgctccngcncactccgagacgcacagcgcctgggctcgctgtcaaggactacgtcagacgtaatcactgacgcggctggacg

SEQ ID NO: 341786 - DNA, 532 bp, Homo sapiens
  misc_feature: GZ8MTXP02J07CA.9.33.C11.1.454.CMB.2.raw
tcagtgatacgtctcacgaccggtgctcgatttagagtgagctcgttgggtttggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgttattactgtacgaaagagggggatacgagtggcagctccaagtactactttgacttctgggggccagggaaccctggtcaccgtctcctcacgcctccaccaagggcccatcggtcttccccctggccgccctgcctcccgaggcgcacctccgagacgcacacgccggcccgtgggctcgcctggcaaaggctacttccagacgtctcactcgagcggctggacg

SEQ ID NO: 341787 - DNA, 571 bp, Homo sapiens
  misc_feature: GZ8MTXP02HWHXI.9.33.C11.1.454.CMB.2.raw
tcagtgatacgtctcacgaccggtgctcgatttagagtgagctcgttgggtttggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaaggccgattcaccatctccagagacaattccaagaacacgatgtatctgcaaatggacagcctaagagttgaggacacggctgtttatactgtaacgaaagagggggatacgagtggcagcctaccaagtactactttgacttctgggggccagggaaccctggtcaccgtctcctcagcctccaccaagggcccatccggtcttccccctggccgccctgcctccaggtacgccaccgtcccgagacgcacacggccggcccgtggggccttcggcccgttgggtacaaacgggaccttccgttacccagtaccgtaatcaacgttcggaacgccgggctacgggaccg

SEQ ID NO: 341788 - DNA, 550 bp, Homo sapiens
  misc_feature: GZ8MTXP02JBFCV.9.33.C11.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggcctcccaggcccctnatcttgatgcatccatcgaggccactggcactccccagccaggttcagtggcaggtgggtctggggacagtaccttcnctctcaccatcagcagcctagacgcctagaagtatttgactagtttattactgtacaaactatacgtaccgtagtcggccgtccgggggcctaccgttccggcccgtacgggaacctaaagtgagactacgaaacgtacgtgtacgcgtacgcacaatctcgttctctacttccttccgtcc

SEQ ID NO: 341789 - DNA, 544 bp, Homo sapiens
  misc_feature: GZ8MTXP02JW2AO.9.33.C11.1.454.CMB.2.raw
  modified_base (384)..(384): a, c, t, g, unknown or other
  misc_feature (384)..(384): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactgggtggagtctggggggggctggtccagcctgggaggtccctgagactctcctgtgcaggctctggattcaccttcagtaactacggcgtgcacgtgggtcccgccaggcctccagggccaaagggggcttggagtggctgggctagttgtttcatctgaggtatgttacaatactatcagactccggtnaaggggccatttccaccatcctccagagaacaattacccaagaaacacgatgtatctagcaaatggacagacctaagagttgaggacacggctagttattactgtaacgaaaggagggggaagtacgagtggcgagctaccaagtactactttacgtacg

SEQ ID NO: 341790 - DNA, 582 bp, Homo sapiens
  misc_feature: GZ8MTXP02HLULG.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggctggtccagccgtgggaggtccctgagactctcctgtgcaggctctggtattccaccttcagtaacctacggcgtgcacgtggtcccgccaggcctccgaggccgaagggcttggagtggctgggctagttgttcatcgtaggaaggtagtgttacaatactaatacagtactcgtagaacgggccattccacatctaccagagacaattaccaaagaacaacgatagtatctagacaagtagacagacctaagagtagaggtacacggtctagtttatacgtaggtaaacggaaaggagggggtaatacgacggtaggacgaacgtactaccgaacgtacgttacgttacgtaacgtttccggg

SEQ ID NO: 341791 - DNA, 595 bp, Homo sapiens
  misc_feature: GZ8MTXP02JTRVP.9.33.C11.1.454.CMB.2.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctcgagggaanagccacctctcctgcagggccagtcagagtgttaccaccagttagcctggtaccaacacaaacctggccaggctcccaggcccctnatctttgatgcatccatcaggccactggcatcccagccaggttcagtggcaggtgggtctggggacagacttcactctcaccatcagcagccctagacgcctgaagtattttgactagtttattactgtacaaactattacggtaccgtagtcgggtcccgtccgggggcctacgtttccgggcccgttaggggaaccctaaaagtttcgaacgtacgtaccgaaaacggtaaccgtggtacggtcgtacggacctaacccgtaattccgttacgttaccttaccgttaccttttaccccgctttaacg

SEQ ID NO: 341792 - DNA, 542 bp, Homo sapiens
  misc_feature: GZ8MTXP02JPURK.9.33.C11.1.454.CMB.2.raw
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (330)..(331): a, c, t, g, unknown or other
  misc_feature (330)..(331): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagcgtggtttcgtcgtaggctctttaagaggtgtccagtgtcaagtgcaactggtggagtctggggggcgtgggtccaggcctgggaggtccctgagctctcctgtgcaggctctggattcaccttcagtactacggcgtgcactggtcgcaggcncngngagngtgngngngtgngtgtgtnntcgtgagagtgtanatactntacacgacgtcgtagacggacgactactacactctcagagacactacaagaacacgatatatnanacagagacgacgacgtagtagtagagacgacgtacgtacgttagttacgtacgtaacggtaaacgggtaacggggtacgtaacgtaggtaacggacgacgacgtacgtaacgtacgttacgttacg

SEQ ID NO: 341793 - DNA, 524 bp, Homo sapiens
  misc_feature: GZ8MTXP02JTVFZ.9.33.C11.1.454.CMB.2.raw
  modified_base (201)..(201): a, c, t, g, unknown or other
  misc_feature (201)..(201): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttaccacccagttagcctggtaccaacacaaacctggccaggctcccaggcccctcatctttgatgcatccatcaggccatggcatcccagccaggttcagtgcagtgggtctggggacngacttcnctctcaccatcagcagcctagagcctgaagtatttgctagtttatactgtacaacatcgtacgagtggccgtccggggcctacgtttcggcccgtgggacctaaagttgagtactacaaacgaactggtacggctcgcacgaatctacgtctcactcctccgtc

SEQ ID NO: 341794 - DNA, 555 bp, Homo sapiens
  misc_feature: GZ8MTXP02G87FT.9.33.C11.1.454.CMB.2.raw
  modified_base (304)..(304): a, c, t, g, unknown or other
  misc_feature (304)..(304): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtggggggggcgtggtccagcctggggaggtccctgagactctcctgtgcaggctctggattcaccttcagtaacctacggcgtgcacgtgggtccnccaggctccgagggcaaggggcttggagtggctggcagttgttcatcgtagaaggtaagtgttacaaatactaatacagactccgtaggaaacgggccgtaattcaaccaatctaccagagacaaataccaaagaacaacgatagtatactgacaaatagacagactaagagtagagacgacgctagttattactagtagaaagaggggatacgagtggagaagctaccagtactactttacgacttacgg

SEQ ID NO: 341795 - DNA, 573 bp, Homo sapiens
  misc_feature: GZ8MTXP02HW7RB.9.33.C11.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttaccacccagttagcctggtaccaacacaaacctggccaggctcccagcccctnatcttgatgcatccatcaggccactggcactcccagccaggttcagtggcaggtgggtctggggacagtacttcacttcacaccattcacgcacgcctagacgcctagaagtatttttgcttagttttatacttagtactaaatacttcgtaccgtagtccgggccggtcccgggggcctaccgtttccggcccgtacggggaacctaaaagttcgaagtactacgaaaacgaactggtacgctacgcacctaattctcgttcttactacttccgtttcccacc

SEQ ID NO: 341796 - DNA, 615 bp, Homo sapiens
  misc_feature: GZ8MTXP02HMK1X.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccacctctcctgcagggccagtcagagtgttaccacccagttagcctggtaccaacacaaacctggccaggctcccaggcccctnatcttgatgcatccatcaggccatggcatcccagccaggtcagtgcagtggctgggacagacttcnctctcaccatcagcagcctagacgcctagagtattttgctagtttacttactgtacaaactattacgtaccggtagttcgggcccgttcccgggggtaccctaccggtttcccgggccccgttaggggaaaccctaaaagtttcggaaacgtaacgttaccgaaaacggtaaaccgttgggtacggtccttacggacccaacccgtaacgtttccttacggtttcctttaccgtactttcccctttacccccggtaccc

SEQ ID NO: 341797 - DNA, 591 bp, Homo sapiens
  misc_feature: GZ8MTXP02GXG7E.9.33.C11.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctnatcttgatgcatccatcaggccactggcatccccagccaggttcagtggcaggtgggtctggggacaggacctttcactctcaccatccagcagccctagacncctagaagtnttttgacttagtttattactgtactaaactctaccgtaccgtagtcgggtcccggtcccgggggtaccctaccggtttcccgggcccgtacgggaaccctaaaagttcgaagtaactacgaaaacgtaacgttggtacggactcggaccacctaactcgtacgtccttactacttcccttcccgacc

SEQ ID NO: 341798 - DNA, 547 bp, Homo sapiens
  misc_feature: GZ8MTXP02F76IY.9.33.C11.1.454.CMB.2.raw
  modified_base (506)..(506): a, c, t, g, unknown or other
  misc_feature (506)..(506): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcgaggctctggattcaccttcagtaactacggcgtgcacgtgggtcccgccaggctccaggccaagggcttggagtggctgggcagtttgttcatctgaaggagtgtacaaatactatacagtactccggtagaacggggccattcaccatcctccagagacaataccaagaacacgatagtatctagacaaatggacagacctaagagtagagacgacggtctagttattactagtacgaaaggagggganacgtagtgacgaagctacctagtactacgttagtacttcgg

SEQ ID NO: 341799 - DNA, 574 bp, Homo sapiens
  misc_feature: GZ8MTXP02GLLKN.9.33.C11.1.454.CMB.2.raw
  modified_base (260)..(260): a, c, t, g, unknown or other
  misc_feature (260)..(260): n is a, c, g, or t
  modified_base (361)..(361): a, c, t, g, unknown or other
  misc_feature (361)..(361): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaagagccacctctcctgcagggccagtcagagtgttaccacccagttagcctggtaccaanacaaacctggccaggctcccaggcccctcatcttgatgcatccatcaggccactggcatcccagccaggttcagtggcagtgggtctggggacagacttcnctctcaccatcagcagcctagacgcctagaagtattttagctagttttatactgtacaaactatacgtacgtagtcggtaccgtccgggggccctacgtttccggcccgtacggggtaacccaaaagtttcgaagtaacttaccgaaaacgtaaacgtggtacggcgtacgaccaacctaatcgtcgttaccttctacttcccttacccgtcc

SEQ ID NO: 341800 - DNA, 541 bp, Homo sapiens
  misc_feature: GZ8MTXP02FQQQK.9.33.C11.1.454.CMB.2.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttcagtaactacggcgtgcactgggtccnccaggctccgaggcaaggggcttggagtggctggctagttgtttcatctgaaggagtgttacaatactatacagactccgngaagggccattcacatctcagagacaatccaagaacacgatgtatctgacaaatgacagacctaagagttagaggacgacggtcttagtttatacgtaggtaacgaaaggagggggtatacgagtcggacagactaacgtaacgtactacttgacttcggtacgggtaccg

SEQ ID NO: 341801 - DNA, 554 bp, Homo sapiens
  misc_feature: GZ8MTXP02FGEU2.9.33.C11.1.454.CMB.2.raw
  modified_base (291)..(291): a, c, t, g, unknown or other
  misc_feature (291)..(291): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctccaggggaaagagccaccctctcctgcagggccagtcagagtgttaccacccagttagcctggtaccaacacaaacctggccaggcctcccaggcccctnatcttgatgcatccatcagggccactggcatcccagccaggttcagtggcaggtgggtctggggacagaccttcactctcaccatcagcagcctagagcctagaagtattttgactagtttattactagtacaaacatacgtaccgagtcggcccgtccgggggccctacgtttccgggcccgtggggaaaccaaaagttcgaagtactacaaaacgtaaactggtacggctacgcaccaagtctcgtctcactccttcccgc

SEQ ID NO: 341802 - DNA, 687 bp, Homo sapiens
  misc_feature: GZ8MTXP02HBK3H.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcacttctacgtaacgtaacgtacggtgtcgactacggtccggtcccgacggacgtcccacgggacggaacggaacggttcggtaggtagggtcggtcgggtcggacgtttaggttttcgttactacgttcgtaaggggtaaaggtacggtttactaaacttaaacttaacttaactacgacgttacccggttacggtaaaggggtacccgggacttacttacccaactactcctaacgaaggaacaaacttaactaaccgaaacgaaaccgtaagtagtacgttactcgtacaaacttaaggacgaacgactaacgtaagtagtaggaacgacgacgtgttattactagtacgtaaacggaaggggagtacaaggtgtagaacgacgtacctaacgtacgttactttacgtacgtttaccgg

SEQ ID NO: 341803 - DNA, 651 bp, Homo sapiens
  misc_feature: GZ8MTXP02IMXMV.9.33.C11.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttacccaccagttacgcctggtaccaacacaaacctggcaggctcccagcccctnatcttgatgcatccatcgaggccagtggcactccccagccaggttcagtggcaggtggtctggggacagtaccttcncttctcaccctatccagcagctagactctagaagttatttgacttaagttttattactagtactaaactacgttaccgtaacccgtagggttccgggtcccggttcccgggggacccttaccggtttccgggccccgttaaggggaaccctaaaagttcgaaaacgtacgttaacgaaaaacggtacgttaggtacggtaccgttacggaacctaaccctaacgttttaccgttccggtttacccttttacccgtaacgttttccccctttaccccggtaacccg

SEQ ID NO: 341804 - DNA, 542 bp, Homo sapiens
  misc_feature: GZ8MTXP02J0FLY.9.33.C11.1.454.CMB.2.raw
  modified_base (203)..(203): a, c, t, g, unknown or other
  misc_feature (203)..(203): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (423)..(423): a, c, t, g, unknown or other
  misc_feature (423)..(423): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcgaggccacgtggcactcccagccaggttcagtgcagtgggctggggacngacttcnctctcaccatcagcagcctagagcctagaagtattttgctagtttattactgtacaanatcgtacgagtcggccgtccgggggcctacgtttccggcccgtgggaacctaaaagttgaagtactacgaaacgactagtcggctacgcacaatctagtccttctactccttcccgacc

SEQ ID NO: 341805 - DNA, 616 bp, Homo sapiens
  misc_feature: GZ8MTXP02HYFZE.9.33.C11.1.454.CMB.2.raw
  modified_base (302)..(302): a, c, t, g, unknown or other
  misc_feature (302)..(302): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggggctggtccagcctggggaggtccctgagactctcctgtgcaggctctggattcaccttcagtaactacggcgtgcacgtgggtccnccaggctccaggcaagggcttggagtggctgggctagtttgttcatctaggaaggagttgttacaaattacttatacaggtacctccgtagaaacggggtccaatttccaaccatcctaccagagaacaattaccaagaacacgatagtatactgacaaataggacagacctaaagagttagaggacgacggtacgttagtttaattaacgtaggttaaacggaaaagggtaaggggggtaataacggtaaggtacggacgaagtccgtaaccgtaaacggttaacctttaacgtttacgtaaccgtttccggg

SEQ ID NO: 341806 - DNA, 579 bp, Homo sapiens
  misc_feature: GZ8MTXP02J257R.9.33.C11.1.454.CMB.2.raw
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaangccaccctctcctgcagggccagtcagagtgttaccacccagttagcctggtacccaacacaaacctggccaggctcccaggcccctnatcttgatgcatccatcagggccactggcactcccagccaggttcagtggcaggtgggtctggggacngacttcnctctacaccatcagccagcctagacgcctagtaagtattttgactagtttattactgtacaactatccggacgtagtcgggcccgtccgggggcctaccggtttccgggacccgttacggggaaccctaaagttcgaacgtactaaccgaaaacgacgtagtcggctacgaccgacctaactcgtacgtctttaccacttcctacccgtcc

SEQ ID NO: 341807 - DNA, 611 bp, Homo sapiens
  misc_feature: GZ8MTXP02J3XRF.9.33.C11.1.454.CMB.2.raw
  modified_base (292)..(292): a, c, t, g, unknown or other
  misc_feature (292)..(292): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctgggctagttgtttcatctgaaggaatgttcaatactatacagactcgtgaagggccatcaccatctccagagacaattccaaagaacacgatgtatctagacaaatggacagacctaagngttagaggacacggtctagttatactaggtacgaaaggagggggatacgagtggcagcctactaagtactactttgacgttcgtggggccaacgggtaccctgtccaccgttctccctcacgccctaccgaaccgaaccggggcccctacggttcccggtcccttccccccgtcgggcccgcccctcgcctcccgagggacccaccaccgtacgagacgacacgcgggccggtcccgtcgggcctcggccgtacggtaaccgaacgtacctacctaccgaacgtacgtaacgacgacgcggacggccggtcgacggacg

SEQ ID NO: 341808 - DNA, 594 bp, Homo sapiens
  misc_feature: GZ8MTXP02IGCU0.9.33.C11.1.454.CMB.2.raw
  modified_base (284)..(284): a, c, t, g, unknown or other
  misc_feature (284)..(284): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccacctgtctttgctccgaggggaagagccaccctctcctgcagggccagtcagagtgttaccaccagttagcctggaccaacacaaactggccaggctcccagcccctnatcttgatgcatccatcaggccagtggcactcccagccaggttcagtggcngtgggtctgggacagtacttcnctctcaccatccagcagcctagacgcctagaagtnttttgacttaagttttacttacgtagttacaaactacgttaccggtaccgtaggttccgggtcccggttccccgggggaccctacggttttccgggacccgttaggggaaccctaaaagttggaacgtactacgaaaacggacttaggtacggcgtacgccacgtaattccgttacgttccttacacctttcctaccccgtc

SEQ ID NO: 341809 - DNA, 615 bp, Homo sapiens
  misc_feature: GZ8MTXP02GQCL7.9.33.C11.1.454.CMB.2.raw
  modified_base (202)..(202): a, c, t, g, unknown or other
  misc_feature (202)..(202): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttagcctggtaccaacacaaacctggccaggctcccaggcccctcatcttgatgcatccatcaggccactggcatcccagccaggttcagtggcagtgggtctggggacagacttcactctcaccatccagcagcctagagcctgaagtatttgctagtttatactgtacaaactatacgtacgagtcggcccggtcccgggggtccctacgtttccgggccccgttacggggtaaccctaaaagtttcgaacgtaacgttaccgtaaaacgaaaaccgttgggttaacggccgttacggacctaaacccgtaagtttacccttacggtttacctttccgtaaccttttccccggtttacccccgtaacccg

SEQ ID NO: 341810 - DNA, 551 bp, Homo sapiens
  misc_feature: GZ8MTXP02G7WIZ.9.33.C11.1.454.CMB.2.raw
  modified_base (545)..(545): a, c, t, g, unknown or other
  misc_feature (545)..(545): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaaggccgattcaccatctccagagacaattccaagaacacgatgtatctgcaaatggacagcctaagagttgaggacacggctgttatactgtacgaaagagggggatacagtggcagcctccaagtactactttgacttcgtggggccagggaaccctgggtccaccggtctaccctcacgccctcccacagggccccagtccggtctcccccgtggccgccctcgacctccaggacgccaccgtccgagacgcacgagccggtccctgggcctgcccgtggtcaagggactcttaccagacgtaagtcactagacgcggacncggacg

SEQ ID NO: 341811 - DNA, 530 bp, Homo sapiens
  misc_feature: GZ8MTXP02IUEL4.9.33.C11.1.454.CMB.2.raw
  modified_base (368)..(368): a, c, t, g, unknown or other
  misc_feature (368)..(368): n is a, c, g, or t
  modified_base (451)..(451): a, c, t, g, unknown or other
  misc_feature (451)..(451): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaagagggggatacgagtggcagcctccaagtactactttgacttcngggggccagggaaccctggtcacgtctctcagcctccacaagggcccatccggtcttccccctggcgccctgcctccaggacnccacctccgagacgcacacgcggccctgggcctgcctggtcaaggctactccagacgtaatcactcgagcggctggacg

SEQ ID NO: 341812 - DNA, 541 bp, Homo sapiens
  misc_feature: GZ8MTXP02I37YQ.9.33.C11.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (513)..(513): a, c, t, g, unknown or other
  misc_feature (513)..(513): n is a, c, g, or t
tcagtgatacgtctcacgaccggtgctcgatttagagtgagctcggttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctgggaggtccctgagactctcctgtgcaggctctggattcaccttnagtaactacggcgtgcactcgggtccnccaggctccaggcaagggcttggagtggctgggcagttgttcatctagaaggtatgttacaattactatacagacctcgtagaacgggccattcaccatctccagagacaattaccaagaacacgatgtatctgacaaagtgaacagacctaaagagttagaggacacggtctagtttattactgttaacgaaaggagggggatacgagtggngaagctacaagtactacgttgacttcgg

SEQ ID NO: 341813 - DNA, 558 bp, Homo sapiens
  misc_feature: GZ8MTXP02JXNER.9.33.C11.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctnatctttgatgcatccatcagggccacgtggcatcccagccaggttcagtggcagtgggtctggggacagacttcactctcaccatcagcagcctagagcctagaagtatttgactagtttaattacttgtacaaactactacgtaccgagtcggcccgtccgggggcctaccgtttccggcccgtacggggaacctaaaagttcgaacggtactacgaaacgaaactgtaggctcgaccaccaactctgttcttcacttccttcccgcc

SEQ ID NO: 341814 - DNA, 538 bp, Homo sapiens
  misc_feature: GZ8MTXP02F60O4.9.33.C11.1.454.CMB.2.raw
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagcctgggaggtccctgagactctcctgtgcaggctctggattcaccttcagtaactacggcgtgcacgtgggtccnccaggctccgaggcaagggcttggagtggctggctagttgttcatctgaaggagtgttacaatactatacagactcctagaagggccattcacatctcaganacaactaccaaagaacacgatgtatctagacaaataggaacagaccgtaagagttagaaggacacgcttagtttattactagtaacgaaaggaagggggatacgagtagaacgagactacgaagtactacttacgtacg

SEQ ID NO: 341815 - DNA, 524 bp, Homo sapiens
  misc_feature: GZ8MTXP02GDK4V.9.33.C11.1.454.CMB.2.raw
  modified_base (290)..(290): a, c, t, g, unknown or other
  misc_feature (290)..(290): n is a, c, g, or t
  modified_base (365)..(365): a, c, t, g, unknown or other
  misc_feature (365)..(365): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatctttgatgcatccatcagggccactggcatcccagccaggttcagtggcagtggggtctggggacagacttcnctctcaccatcagcagcctagagcctgaagattttagctagtttattactgtcaaacatcgtaccgagttggccgttcgggggcccacgtttcggcccttgggaccaaaatgagatcaaacgaactgtggctgcaccaatcgtntcttcatcttcccnc

SEQ ID NO: 341816 - DNA, 546 bp, Homo sapiens
  misc_feature: GZ8MTXP02JAFFC.9.33.C11.1.454.CMB.2.raw
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
  modified_base (472)..(472): a, c, t, g, unknown or other
  misc_feature (472)..(472): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcggtgggggggcgtggtccagccgtgggacggtccctgagactctcctgtgcaggctctggattccaccttcagtaactacggcgtgcacgtgggtcccgccaggcctccgaggcgaagggcttggagtggctgggctagttgttcatcgtagaaggtagtgttacaatactatacngtactcgtagaacggcatcacatctacaganacaataccaagaacacgatagtatctagacaaagtgacagactaaagagtagagacgacgtntagttacttacgtagtaacggaaaggaggggaactacgagtgacaagctacacgtactacgtttcgacgttcgg

SEQ ID NO: 341817 - DNA, 613 bp, Homo sapiens
  misc_feature: GZ8MTXP02IXCCO.9.33.C11.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtcgttaccacccagttacgcctggtaccaacacaaactggccaggctcccaggcccctnatcttgatgcatccatcagggccactggcactcccagccaggtcagtgctaggtggtctgggacngacttcnctctcaccatcagcacgcctagacgcctagaaacgtntttgacttaagtttaattactagtacaaacgtacttaccggtaccgtaggtccgggtcccggtcccgggggtccctaccgtttcccgggacccgtacggggtaaaccctaaaagtttcggaaacgtaacgtaccgaaaacggtaacgtggtcggccgttacggacctaccgaacttcgtcgttaccttactaccgttccctttccccgtacc

SEQ ID NO: 341818 - DNA, 587 bp, Homo sapiens
  misc_feature: GZ8MTXP02GP6XH.9.33.C11.1.454.CMB.2.raw
  modified_base (203)..(203): a, c, t, g, unknown or other
  misc_feature (203)..(203): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggcctcccaggcccctcatctttgatgcatccatcagggccactggcatccccagccaggttcagtcggcaggtggggtctggggacagacttcactctcaccatcagcacgcctagacgcctagaagtatttgcttagtttattactgtacaactattaccgtacgtagtcgggaccgtccgggggcctacgtttcccgggcccgttacgggaacctaaagttcggaagtaacgtacgaaaacgtacgttacggtacgggtcctacggaccacctaacgttctacgttcttactacttccttcccgtaccc

SEQ ID NO: 341819 - DNA, 554 bp, Homo sapiens
  misc_feature: GZ8MTXP02IHNRE.9.33.C11.1.454.CMB.2.raw
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagtgatacgtctcacgaccggtgctcgatttagagtgagctcgttgggtttggggaggaactgctcagttaggacccagagggaaccatggaagcccagctcagcttctcttcctcctgctactctggctcccagataccaccggagagattgtgttgacacagtctccagccaccctgtctttgtctccaggggaagagccacctctcctgcagggccagtcagagtgttaccacctagttacgcctggtaccaacacaaacctggccaggctcccaggcccctnatcttgatgcatccatcaggccactggcatccccagccaggttcagtggcaggtgggtctgggacngtacttcnctctcaccatccagcagcctagacgcctagaatatttgcttagtttattactagtcaaactatcgtaccgagtcggccgtaccggggcctacgtttcggccgtagggacctaaaagttcgaagtactacgaaaacgtactaggtcggtctacgcaacctaagttcctgttccttctacttcctttcccgacc

SEQ ID NO: 341820 - DNA, 554 bp, Homo sapiens
  misc_feature: GZ8MTXP02I23V3.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (362)..(362): a, c, t, g, unknown or other
  misc_feature (362)..(362): n is a, c, g, or t
  modified_base (426)..(426): a, c, t, g, unknown or other
  misc_feature (426)..(426): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttacgcctggtaccaacacaaacctggccaggctccaggcccctnatcttgatgcatccatcaggccactggcactcccagccaggttcagtggcaggtggtctgggacagacttcnctctcaccatcagcagcctagacgcctagaagtattttagcttaagtttattactgtcaaactnttccgtacgagtcggcccggtccgggggcctacgtttcggcccgtagggaacctaaagttgaagtactacgaaacgactggtacggctagccaaccgtaatctgttaccttctactcctttcccgacc

SEQ ID NO: 341821 - DNA, 580 bp, Homo sapiens
  misc_feature: GZ8MTXP02HB17D.9.33.C11.1.454.CMB.2.raw
  modified_base (367)..(367): a, c, t, g, unknown or other
  misc_feature (367)..(367): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaaagagggggatacagtggcaggcctccaagtactactttgacttcgngggggccagggaacccgtggtccaccggtctcccttcacgccctccaccaagggcccatccgggtccttcccccgtggccgccctgcctccgacgggcgaccacccgtccgacgacgcacgacgccggcccgtgggcctcgacccgttggcgaaacggcctacgttcccacggtacgtaacgtcaaccgtggacgccggggctacgggaccgg

SEQ ID NO: 341822 - DNA, 546 bp, Homo sapiens
  misc_feature: GZ8MTXP02G5XYW.9.33.C11.1.454.CMB.2.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatcttgatgcatccatcaggccagtgcatccccagccaggttcagtggcaggtgggtctgggacagtacttcnctctcaccatcagcacgcctagacgcctagaagtattttgctagtttaattactgtacaaacatcgtacgagtcgcccggtccggggcctacgtttcggccctagggaacctaaaagttgaagtactaacaaacggtaactggtggctcgacaccaagttctcgtcttacactccgttcccac

SEQ ID NO: 341823 - DNA, 547 bp, Homo sapiens
  misc_feature: GZ8MTXP02GFKQ0.9.33.C11.1.454.CMB.2.raw
  modified_base (301)..(301): a, c, t, g, unknown or other
  misc_feature (301)..(301): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccnccaggctccaggcaaggggcttggagtggctgggctagtttgtttcatctggaaggagtgttacaatactatacagtactccggtagaagggccattcaccatctccagacgacaataccaagaacacgatagtatctagacaaatagacagacctaagagtagagacacgctagtttattacgtagtaacggaaaggagggggatacgagtggacgaagctacacgtactacttacgactttcgg

SEQ ID NO: 341824 - DNA, 572 bp, Homo sapiens
  misc_feature: GZ8MTXP02HF0A2.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (364)..(364): a, c, t, g, unknown or other
  misc_feature (364)..(364): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggctcccaggcccctnatctttgatgcatccatcaggccatggcatccccagccaggttcagtggcaggtgggtctggggacagacttcnctctcaccatccagcagcctagacgcctagaagtatttgactagtttattactgtacaactatcgtacgagtcggaccgtccgggggcctacgtttccggcccgttacgggaacctaaagttcgaacgtacgtacgaaacgtaaccgtggtacggtactacgacctaaccaagttcctacgttccttactactttccttaccccgtcc

SEQ ID NO: 341825 - DNA, 578 bp, Homo sapiens
  misc_feature: GZ8MTXP02IA9UL.9.33.C11.1.454.CMB.2.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgctccgagggaanagccacctctccngcagggccagtcagagtcgttaaccaccagttacgcctaggtaaccaaacaccaaacctggccaggcctcccgaggcccctnattcttgatgcatccatcgaggccagtggcactcccagccaggttcaggtggctaggtgggtctggggacaggtacttcnctctcacccatcagcacncctagcgcctagaagtattttagcttaagtttattactgtacaaactattaccgtacgtaggtcggtcccgtccgggggcccttaccgtttccggcccgtacgggacctaaaagtgaacgacgtacgaaacgacgttcgtacggctcgaccactaacgtctcgtacttcacttccttacccgacc

SEQ ID NO: 341826 - DNA, 575 bp, Homo sapiens
  misc_feature: GZ8MTXP02F5K1Q.9.33.C11.1.454.CMB.2.raw
  modified_base (205)..(205): a, c, t, g, unknown or other
  misc_feature (205)..(205): n is a, c, g, or t
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagngccaccctctcctgcagggccagtcagagtgttaccaccagttagcctggtaccaacacaaactggccaggctccaggcccctnatcttgatgcatccatcaggccactggcatcccagccaggttcagtggcaggtgggtctggggacagacttcactctcacatcaagcagcctagacgcctagaaagtattttgactagttttattacgtagtacaaactatcgtaccgagtcgggccgtccggggcctacgtttccggccgtacgggaacctaaaagttcgaacgtaacgtacgaaaacgtaacgtaggtcggtactacggaccaacctaagtccttagttccttactacttcctttccccgtacc

SEQ ID NO: 341827 - DNA, 674 bp, Homo sapiens
  misc_feature: GZ8MTXP02H9RGA.9.33.C11.1.454.CMB.2.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccgaagggaanagccaccctctcctgcagggccagtcagagtcgttaccaccagttacgcctaggtaaccaaacaccaaaccgtggccaggcctcccacggcccctnatctttgatgcatccatcgacggccacgtggccactcccgagccgtaggttcaggtggcaggtgggtcgtagggacagtacttcactctacactatcagcacgccctagcgtaccgtagtaaacgttagtttttagacttaagttttaacttacttcgtaactaaacgtacgttacggtaccggtacggtcgggcccgggttcccgggggtcctaccggtttccgggacccgttacggggtaaaccctaaaagtttcggaacgtaacgtaaaccgtaaaacggtacgttacggtacggtaccgtacgaaccctaaccgttaacgttccgttaccggtttactttacccgtaacctttcccgtttacccccggtacc

SEQ ID NO: 341828 - DNA, 559 bp, Homo sapiens
  misc_feature: GZ8MTXP02JJQ9N.9.33.C11.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangcccaccctctcctgcagggccagtcagagtgttaccaccagttacgcctggtaccaacacaaacctggccaggcctcccaggcccctnatcttgatgcatccatcaggccagtggcactcccagccaggttcaggtggcaggtgggtcgtgggacagacttcnctctacaccatcagcagcctagacgcctagaagtnttttgctagtttatactgtacaactatcgtacgagtcggtcccggtccgggggcctacgttccggcccgtagggaacctaaaagttgagtactacaaacggtactggacggctacgccaccgtaacttcgtcgttactctaccttccctccgtacc

SEQ ID NO: 341829 - DNA, 579 bp, Homo sapiens
  misc_feature: GZ8MTXP02FSHB4.9.33.C11.1.454.CMB.2.raw
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctccaggggaagagccaccctctcctgcagggccagtcagagtgttaccaccagttagcctggtaccaacacaaacctggccaggctcccaggcccctnatcttgatgcatccatcgaggccactggcactcccagccaggtcagtgcaggtggtcngggacagacttcnctcncacatcagcacgcctagacgcctagaagtatttgacttagtttattactgtacaaactatacgtacgaggtcggacccggtccgggggccctaccggtttccggccccgttaggggaaccctaaaagttcgaacgtactaccgaaaacgtaaccgttggtacgggcttacgacctaaccaagttcttcgttccttactacttcccttacccgtacc

SEQ ID NO: 341830 - DNA, 558 bp, Homo sapiens
  misc_feature: GZ8MTXP02JB102.9.33.C11.1.454.CMB.2.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (403)..(403): a, c, t, g, unknown or other
  misc_feature (403)..(403): n is a, c, g, or t
tcagtgatacgtctcacgaccggtgctcgatttagagtgagctcgttgggtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggcagttgttcatctgaaggagtgttcaatactatacagactcgtgaaggccattcaccatcnccagagacaattccaaagaacacgatgtaatctgccaaatggaacagcctaagngttgaggacacggctgtttatactgtacgaaagaggggganacgagtgcagctaccaagtactactttgacttcgtggggaccagggaacctcggtccaccgtctcctcacgccgtccaccgaacgggcccacgtccggtccttcccccgtcggcccgccctcgccgtccgacggacgtccacccgtccgacgacg

SEQ ID NO: 341831 - DNA, 566 bp, Homo sapiens
  misc_feature: GZ8MTXP02GZJMI.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggcctcccagcccctnatcttgatgcatccatcaggccatggcatcccagccaggttcagtggcaggtggtctgggacagacttcactctacaccatccagcagcctagacgcctagaagtnttttgctaagtttatactgtacaaactntacgtacgagtcggcccgtccggggcctacgtttccggccctagggaacctaaaagttgaacgtaacgtacaaaacgtacgtggtacggtcctacgaccaacctaattcccgtgttacttcctaacttcccgttaacccgcc

SEQ ID NO: 341832 - DNA, 618 bp, Homo sapiens
  misc_feature: GZ8MTXP02IEKLK.9.33.C11.1.454.CMB.2.raw
  modified_base (264)..(264): a, c, t, g, unknown or other
  misc_feature (264)..(264): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttnagtaactacggcgtgcacgtggtccgccaggctccgaggcaaggggcttggaggtggctggctagtttgtttcagtctaggaaggtaagttcgttaccaaagttactaattaacacgtaccttccgggtagaaacggggcccgtaatttccgaccatccctacccagacgaacaacttaccaaagaacaacgtatagtatctagacaaagtggacaagtacctaaaggagttagaacggtacgacggtcttaagtttactaacgtaggtaaacggaaaggggagggggtaataacggaggtcgcgtagacgtaaccgaagttacttacttacgtacgttacggtcggggaaccg

SEQ ID NO: 341833 - DNA, 540 bp, Homo sapiens
  misc_feature: GZ8MTXP02G4YLF.9.33.C11.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
  modified_base (539)..(539): a, c, t, g, unknown or other
  misc_feature (539)..(539): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaaangccaccctntcctgcagggccagtcagagtgttaccaccagttagcctggtaaccaacacaaacctggccaggcctcccaggcccctnatcttgatgcatccatcaggccatggcatcccagccaggttcagtggcaggtgggctgggacagtacttcnctctcaccatcagcacgacctagacnctagaagtnttttagctagtttattactgtacaaanttcgtacgagtcggccgtccgggggcctaccgtttcggccgtgggaacctaaagttgaacgtactacgaaacgacgtagtcggctacgcactaagtctactctctactccttcccnc

SEQ ID NO: 341834 - DNA, 627 bp, Homo sapiens
  misc_feature: GZ8MTXP02HCGZA.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgagacacggctgtttatactgtacgaaaggagggggatacgagtggcagcctcaagtactacttgacttcgtggggaccagggaaccctggtccaccgtctccctcacgccctcccaccaacgggccccagtcccggtccttcccccgtggcccgccctcgccttccgacgggtacgcccaccgtccgaacgacgccaaccgacggcccggccccgtggggcccctcgggtccccgtacggggttaccgaaacggggtaccttaacccgtttacccgaacggtaacccggtaattccgaacgttacggacggccggggtacgtacgggaaccgg

SEQ ID NO: 341835 - DNA, 667 bp, Homo sapiens
  misc_feature: GZ8MTXP02I5FCF.9.33.C11.1.454.CMB.2.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaangccaccctctcctgcagggccagtcagagtgttacccacctagttagcctggtaccaacacaaacctggccaggcctcccaggcccctnatcttgatgcatccatcaggccagtggacactcccagcctaggttcaggtggctaggtggtcctggggacagtacttcacttcacaccatcagcagcctagacgcctaggaagtagttttagcttaagttttacttactacgtactaaactacgttaccgttaccgtaggttcccgggtacccggttaccccgggggtacccttacccggttttcccggggacccccggttacggggtaaaccccgtaaaagtttacggaacggtaaactaaccgtaaaaccggtaaccgttaggttacgggtccttacggacccgtaacctaacgtttacctccggtttaccttacctactttcccggttacccccgtaccg

SEQ ID NO: 341836 - DNA, 588 bp, Homo sapiens
  misc_feature: GZ8MTXP02HW2RX.9.33.C11.1.454.CMB.2.raw
  modified_base (299)..(299): a, c, t, g, unknown or other
  misc_feature (299)..(299): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcaagtaactacggcgtgcacgtgggtccnccgaggcctccgaggcaaaggggcttgggagtggctggctagttgtttcatctagaaaggtaagttgttacaaatactaatacagactccgtagaaagggcccaattcccaccatctccaagacgaacaaattaccaaagaaacaacgatagtatctagacaaaagtgaacagactaaagagttaggaaggacacgggcttagtttaactactaggtaaacgaaagggacgggggtaatacgaggtacggcgaacggacctacgaaacgtaccttacgtttacgtaccg

SEQ ID NO: 341837 - DNA, 531 bp, Homo sapiens
  misc_feature: GZ8MTXP02J0RXB.9.33.C11.1.454.CMB.2.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtcttgtctccaggggaaanagccaccctctcctgcagggccagtcagagtgttaccacccagttagcctggtaccaacacaaacctggccaggctcccaggcccctnatcttgatgcatccatcaggccactggcatcccagccaggtcagtggcagtgggtctgggacngacttcnctctcaccatcagcagcctagacgcctagaacgtattttgctagtttattactgtacaactattcgtaccgagtcggcccgtccgggggcctacgtttcggccctgggacctaaagtgagactacaaacgactagtcgactcgcacaagtctacgtcttcactccttccgcc

SEQ ID NO: 341838 - DNA, 603 bp, Homo sapiens
  misc_feature: GZ8MTXP02H5Y1F.9.33.C11.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (348)..(348): a, c, t, g, unknown or other
  misc_feature (348)..(348): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccacctgtctttgctcagggaanagccacctctcctgcaggccagtcagagtcgttaccaccagttagcctaggtaccaacacaaacctggccaggctcccaggcccctnatcttgatgcatccatcaggccatgcatccagccagtcagtgcagtggtctgggacagacttcnctctcacctatcagcagaccctagacgcctagaagtattttacgtacttaagttttaattacttagtactaactacgttaccgtaaccggtagtacgggcccggtcccgggggtacctaccggtttaccggtcccggtacgggtaacccgtaaaagttacgaacgtaacgtaaaccgtaaacgtaaaccgtaggtacggtacgtacgaccacctaacgtacttacgttacttctaccttaccgtttccccgtacc

SEQ ID NO: 341839 - DNA, 606 bp, Homo sapiens
  misc_feature: GZ8MTXP02H8I34.9.33.C11.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtcttttgctccgaaggggaanagcccaccctctcctgcagggccagtcagagtgttaccaccagttacgcctggtaccaacacaaacctggccaggctcccaggcccctnatcttgatgcatccatcaggccagtggcactcccagccaggttcaggtggctggtggtctgggacagtacttcactctcaccatcagcagacctagacgacctagtaacgtattttagtacttaagttttacttacttgtactaaactacgttacgtaccggtaggtcgggtccggtcccgggggtcctaccggtttccggtacccgtacgggtaaccgtaaaagttcgaacgtaactacgaaaacgtacgtaggtacggtacgtcgaccaccgtaacttctacgttcttacctactttcccttacccgtaccg

SEQ ID NO: 341840 - DNA, 537 bp, Homo sapiens
  misc_feature: GZ8MTXP02H26OU.9.33.C11.1.454.CMB.2.raw
  modified_base (334)..(334): a, c, t, g, unknown or other
  misc_feature (334)..(334): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtcctgagactctcctgtgcaggctctggattcaccttcagtaactacggcgtgcacgtgggtcccgcaggctccgaggcaagggcttggagtggctggcagttnttcatctgaaggtatgtacaatactatcagactccggtagaagggccattccaccatctccagacgacaaattaccaagaacacgatgtaatctgacaaataggacagaccgtaagagttagaaggacacggctagtttactacgtagtaacgaaaggaggggagtacgagtgaacgagactacgtagtactactttcgtacg

SEQ ID NO: 341841 - DNA, 594 bp, Homo sapiens
  misc_feature: GZ8MTXP02G2MUN.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcacgtcgggtccgccaggcctccgagggcaaggggcttggagtggctgggctagttgtttcatcgtggaaggtagtgttacaaatactaatacagtactccggtaggaaacgggccaatttccaccatcctacccagacgacaaacttaccaaacgaacaacgaatagtatactgacaaatggaacagacctaagagttagaggacgacggtactagtttaacttacgtagtaaacggaaagggtagggggaactacgagtggacgaagctaccgtaacgttactacgtttacgtacgtttccgg

SEQ ID NO: 341842 - DNA, 531 bp, Homo sapiens
  misc_feature: GZ8MTXP02FYNQ5.9.33.C11.1.454.CMB.2.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttagcctggtaccaacacaaacctggccaggctcccaggcccctcatctttgatgcatccatcagggccatggcatcccagccaggttcagtggcagtgggtctgggacagacttcnctctcacatcagcagcctagagcctagaagtatttgctagtttattactgtacaactatacgtaccgagtcggtccgtccgggggcctacgtttcggcccgttcgggaccaaagttcgagactacaaacgactgcggctcgcacaatctcgtacttcactcctccgtacc

SEQ ID NO: 341843 - DNA, 735 bp, Homo sapiens
  misc_feature: GZ8MTXP02JQFQY.9.33.C11.1.454.CMB.2.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanacgcccaccctctcctgcagggccagtcagagtgttaccaccagttacgcctggtaaccaacacaaaccgtggccaggctcccacggcccctnatcttgatgcatccatcgacggccacgtcggcacgtccccagcctagggttccaggtcggcacgggtcggggtcgtaggggacctaggtacctttcgaccttcctaccaaccctatccgaacggccaacggtaccctaaggaccgtacccgtaggtaaacgttagttttacgacgtttaaggttttaactttaacttacggttaacctaaacgtacgttaccggtaaccggtacggtccgggtccccggtacccgggggtcccttaaccggtttcccggggtaccccggtaacgggggtaaaccctaaaaggttcggaaacggtaacgtaaccgtaaaaccggtaaccgttagggtacggtaccgtacggaccctaaccctaacgttaccgtttacggttccctttaccgtaacctttcccccgttaccccggtaccc

SEQ ID NO: 341844 - DNA, 659 bp, Homo sapiens
  misc_feature: GZ8MTXP02INMPL.9.33.C11.1.454.CMB.2.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttacccacctagttacgcctggtaaccaacaccaaacctggccaggcctcccgaggcccctnattctttgatgcatccatcgacggcccacgtggcactccccgagccctaggttcaggtggcaggtcggggtctggggacagtaccttcacttctcaccctatccagcagcctagacgtcctagaagttattttgacttagttttacttacgtagtactaaactacgttaccgtaccggtaggtccgggtacccggttccccgggggtacccttaccggtttcccggacccgtacggggtaacccttaaaagttcggaacgtaacgtaaccgaaaacggtacgttaggtacggtaccgtacgacctaaccgtaacgttccttacggtttcctttaccgtacctttcccgttaccccgtaccg

SEQ ID NO: 341845 - DNA, 513 bp, Homo sapiens
  misc_feature: GZ8MTXP02FLRK5.9.33.C11.1.454.CMB.2.raw
  modified_base (438)..(438): a, c, t, g, unknown or other
  misc_feature (438)..(438): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaaagagggggatacagtgcagcctcaagtactacttgacttctggggccaggggaaccctgtcacgtctcctcagcctccaccaaggcccatccggtctcccctgcgcctgctccaggngcacctcgagagcacagcgccctgggctgcctggtcaaggacacttccagaccgtaatcactgagcggctggacg

SEQ ID NO: 341846 - DNA, 553 bp, Homo sapiens
  misc_feature: GZ8MTXP02HNMTG.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctctgatcaccttcagtaactacggcgtgcactgggtccgccaggctccagggcaaggggcttggagtggctgggcagttgttcatcgtgaaggtaagtgttacaagtactatacagtactccgtagaagggtccgatcaccatctccagagacaattacaagaacacatacgtatcagacaaagtagacagactaagagttagaggacacggtctagtttatactagtacgaaaggagggggaactacgagtagacgaagactaccgtaagtactacgttacgtactttacgg

SEQ ID NO: 341847 - DNA, 644 bp, Homo sapiens
  misc_feature: GZ8MTXP02H0FCT.9.33.C11.1.454.CMB.2.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
  modified_base (408)..(408): a, c, t, g, unknown or other
  misc_feature (408)..(408): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccacctgtctttgtctcgagggaanagccacctctcctgcagggccagtcagagtcgttaccaccagttacgcctaggtaccaacacaaacctggaccaggctcccacggcccctnatcttgatgcatccatcgacggccagtggcactcccagccaggttcaggtggcaggtgggtctggggacagtacttcnctctacaccatcagcacgcctagacgtcctagaaacgttnttttagactttagttttaactacgttgtaacaaactacgttaccggtacggtagtaccgggtcccggtcccgggggtaccttacccgggtttcccgggacccgttaacgggaaacccttaaaagttacggaacgtaacgtaaacccgtaaacggtaaacttcgggtacggtaccgtacggacctaaccgtaacgttccgttacgttaccttacgtacctttccctttaccccgacc

SEQ ID NO: 341848 - DNA, 697 bp, Homo sapiens
  misc_feature: GZ8MTXP02GYXVO.9.33.C11.1.454.CMB.2.raw
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccacctgtctttgtctccgaaggggaaancgccaccctctcctgcagggccagtcagagtcgttaccacctagttacgcctggtaacccaacaaccaaaccgtggacccaggccctacccacgaccccctnacttctttgatgcatccatcgaggccatggcactcccagcctaggtcaggtggcaggtgggtctaggggactagtaccttcaccttctacacctatccaagcacgtccctagaccgtcctaggtaaagttctttttaggacctttaagtttttactaaccttgtaacctaaacgtcttaccggtaacccggtaggtcccgggtaccccgggtacccgggggtcccttaaccggttttcccggggaccccgttaacgggggtaaaaccctaaaaggtttcggaaaacggtaacttaaaccggaaaaccgtaacgtgggttaccggacctacggaccaaccgtaacgttccttacggtttaccttacaaccgttttccccgttacccctacc

SEQ ID NO: 341849 - DNA, 544 bp, Homo sapiens
  misc_feature: GZ8MTXP02GOPRO.9.33.C11.1.454.CMB.2.raw
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtggtccnccaggctccagggcaaggggcttggagtggctggcagtttgttcatctgaaggtagtgttacaatactagtacagactccgtagaagggccattcacatctccagagacaattacaagaacacgatgtatctanacaatggacagacctaagagttagaggacacggactagtttattactagtaacggaaaggtagggggatacgagtggacaagtctacgacgtactactttacgtacgtttacgg

SEQ ID NO: 341850 - DNA, 609 bp, Homo sapiens
  misc_feature: GZ8MTXP02IDOGJ.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactcgtgaaggccgattcaccatctccagagacaattccaagaacacgatgtatctgcaaatggacagcctaagagttgagacacggctgttatactgtacgaaagaggggatacgagtggcagcctaccaaagtactactttgacttcgtggggacctacgggaaacccctggtacctaccgtcctcccgtacacgcccttcccgaacccgaaacggggccccctaagttcccggggttcccttcccccccgtgggtcccgcccccttcgtcccttcccgacgggacgccacccgtacccgagacgccacgacgccggcccgtgggcctcgcccgtggaccaaaggacctacgttaccgagacgtaacttcgaactcggacgccgggctggaccg

SEQ ID NO: 341851 - DNA, 613 bp, Homo sapiens
  misc_feature: GZ8MTXP02G2Q4R.9.33.C11.1.454.CMB.2.raw
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (428)..(428): a, c, t, g, unknown or other
  misc_feature (428)..(428): n is a, c, g, or t
  modified_base (510)..(510): a, c, t, g, unknown or other
  misc_feature (510)..(510): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtgggggggggcgtggtccagccgtggggacggtccctgagactctcctgtgcaggctctggattccaccttcagtaactacggcgtgaaaacncgtcgggtcccnccgaggcctccgaggcgaaggggtcttggagtggctgggctaggtttgtttcatcgtaggaaaggtagttgttacaattactaatacagacctccggtaggaacgggcctattccaaccntcctaccagagaacaactaccaaagaacacgatagtatactagacaaagtcggaacagaccgtaagagtagaggacgacgtnttagtttatacgtagtaacggaagggagggggactaacgaggtacggacgagtaccgtaaccgtaagttaccttacgttacgtacgttcggtacggggtaccg

SEQ ID NO: 341852 - DNA, 540 bp, Homo sapiens
  misc_feature: GZ8MTXP02IO3B0.9.33.C11.1.454.CMB.2.raw
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
tcagtgatacgtctcacgaccggtgctcgatttagagtgagctcgttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggcgtggtccagcctgggaggtccctgagactctcctgtgcaggctctggattcaccttcagtaactacggctgcactgggtccnccaggctccaggcaagggcttggagtggctggcagttgttcatctgaaggagtgttcaatactatacngactcgtgaacgggccattcaccatctaccagagacaattaccaaagaacacgatgtatctgacaaatgacagacctaagagttagaggacgacggtactgttaattacgtagtacgaaaggaagggggatacgtagtagacgtaagactacgacgtactactttacgtacttcgg

SEQ ID NO: 341853 - DNA, 523 bp, Homo sapiens
  misc_feature: GZ8MTXP02JW3BK.9.33.C11.1.454.CMB.2.raw
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
  modified_base (506)..(506): a, c, t, g, unknown or other
  misc_feature (506)..(506): n is a, c, g, or t
  modified_base (520)..(520): a, c, t, g, unknown or other
  misc_feature (520)..(520): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccagagacaattccaaagaacacgatgtatctgcaaatggacagcctaaagagttgaggacacggctgtttattactgtacgaaagaggggganacagtggcagcctcaagtactacttgacttntggggccagggaaaccctgtcaccgtctcctcagcctccaccaagggcccatccgtcttcccccgtggccnccctgctccgagacgcacctcgagagcacagccgcctgggctcgactggacaaggactactccagactaancactgagcggtcgngcg

SEQ ID NO: 341854 - DNA, 603 bp, Homo sapiens
  misc_feature: GZ8MTXP02GXA1I.9.33.C11.1.454.CMB.2.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (374)..(374): a, c, t, g, unknown or other
  misc_feature (374)..(374): n is a, c, g, or t
  modified_base (415)..(415): a, c, t, g, unknown or other
  misc_feature (415)..(415): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaanagcccaccctctcctgcagggccagtcagagtcgttaccaccagttagcctggtaccaacacaaactggccaggcctcccacgcccctnatcttgatgcatccatcgaggccacgtggcactcccagcctagggttcagtggctaggtgggtctggggacagtacttcnctctcaccatcgacgcacgcctagacgccgtaggaaagttnttttagacttaagttttactactagtaccaaacgtctaccggtacgtaggtcgggtcccggtaccgggggtccctacggtttccggacccgtagggaaaccctaaagttcgaagtacgtacgaaaacgtacgtgtacggactacgacaccgtaattccgtacgttcctactacctttcctacccgtac

SEQ ID NO: 341855 - DNA, 533 bp, Homo sapiens
  misc_feature: GZ8MTXP02GG57F.9.33.C11.1.454.CMB.2.raw
  modified_base (297)..(297): a, c, t, g, unknown or other
  misc_feature (297)..(297): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccnccaggctccaggcaaggggcttggagtggctggcagttgttcatctgaaggagtgttacaaatactatacagactccgtagaaacggggccattccaccatctccagagacaataccaagaacacgatgtatctagacaaagtggacagacctaagagttagaggacacggctagtttatactagtacgaaaggaggggatacgagtgcgagctacaagtactacgtttacgtacg

SEQ ID NO: 341856 - DNA, 568 bp, Homo sapiens
  misc_feature: GZ8MTXP02JRQVC.9.33.C11.1.454.CMB.2.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaanacaaacctggccaggctcccaggcccctcatcttgatgcatccatcagggccagtggcactcccgagccaggttccagtggcaggtgggtctggggacagacttcactctcaccatcagcagcctagacgcctgaagtatttgactagtttattactgtacaaactactacgtaccgtaggtacggccgtccgggggcctaccgtttccggcccgtacgggaacctaaaagttcggaagtactaccgaaaacgaacgtaggtagcctaggccactaacgtccgttactcctactacctcctacccgac

SEQ ID NO: 341857 - DNA, 539 bp, Homo sapiens
  misc_feature: GZ8MTXP02F3FIQ.9.33.C11.1.454.CMB.2.raw
  modified_base (296)..(296): a, c, t, g, unknown or other
  misc_feature (296)..(296): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccnccaggctccgaggcaaggggcttggagtggctggctagttgttcatctagaaggtagtgttacaatactatacagactccgtagaacgggcattcacatctcagagactatcaaagaacacgatgtatctagacaatggacagacctaagagttagaggacgacgtcttagttacttacgtaggtaacggaaaggacgggggtactacgagtagaacgagactacgaagtactacgttgtacg

SEQ ID NO: 341858 - DNA, 567 bp, Homo sapiens
  misc_feature: GZ8MTXP02JELUK.9.33.C11.1.454.CMB.2.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (363)..(363): a, c, t, g, unknown or other
  misc_feature (363)..(363): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaanacaaacctggccaggctcccaggcccctnatcttgatgcatccatcaggccatggcatccccagccaggttcagtggcaggtgggtctggggacagacttcnctctcaccatcagcagcctagacgcctagaagtattttgcttagtttattactgtacaactatcgtaccgtagtcggccggtcccgggggcctacgtttccggcccgtacgggaaccctaaagttgaacgtactacgaaacgtaacgtggtacggtcgtacgccaacctaatccgttacgttccttactacttccttctacccg

SEQ ID NO: 341859 - DNA, 604 bp, Homo sapiens
  misc_feature: GZ8MTXP02GA7V9.9.33.C11.1.454.CMB.2.raw
  modified_base (246)..(246): a, c, t, g, unknown or other
  misc_feature (246)..(246): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccaganacaattccaagaacacgatgatctgacaaatggaacagacctaagagttgaggacacggctgtttatactgtaacgaaaaggagggggatacgagtaggcagcctacaagtactactttgacttcgtggggaccagggaaccctgcaccgtctccctacacgccctacccaaccgaacgggccctacgtccggtccttcccccgtggcccgtccctgcctccgaggacgcctaacccgcgaacgacaccgaacgcgccggtacccgcgggcctcggtccgttacggacgaaacggtacccttaccgttaccgacggtaacgtaactacgaccgtaggaccggcggacgtcggaaccgg

SEQ ID NO: 341860 - DNA, 522 bp, Homo sapiens
  misc_feature: GZ8MTXP02JURJ5.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaactggccaggctcccaggcccctnatcttgatgcatccatcaggccatggcatcccagccaggttcagtggcagtggctgggacngacttnctcncaccntcagcagcctagagcctgaagtattttgctagtttattactgtacaacatcgtacgagtcggccgtccgggggccacgtttcggcccgtgggaccctaaagttgagtactacgaaacgactagtcgctcgcacaagtctcgtcttcactctccgtc

SEQ ID NO: 341861 - DNA, 563 bp, Homo sapiens
  misc_feature: GZ8MTXP02JS2MI.9.33.C11.1.454.CMB.2.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
  modified_base (449)..(449): a, c, t, g, unknown or other
  misc_feature (449)..(449): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaanagcccaccctctcctgcagggccagtcagagtcgttacccaccctagttacgcctaggtaacccaacaccaaaccctggcccaggcctcccgaggcccctnatctttgatgcatccatcgaggccagtggcatcccagcctaggttcagtggcaggtgggtctggggacagtaccttcactctacaccatccagcacgcctagacgcctagaattatttgactagtttactactagtacaaactntacgtaccgtagtcgggcccggtccgggggcctacgttccggcccgtagggaacctaaagtgagtactacaaacgactggcgctcgcacaatctacgtctacactccttccgac

SEQ ID NO: 341862 - DNA, 578 bp, Homo sapiens
  misc_feature: GZ8MTXP02F37TR.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtcgggtcccgccaggcctccgaggcaagggcttggagtggctggctagttgttcatcgtagaaaggagtgttacaaatactaatacgagacctccggtagaacggggcctattcaccatctacaagagaacaataccaaagaaacaacgatagtaatacgtagacaaaataggaacaacgaaccgtaaagagttaggaagacgacgtcttagtttattacgtagtaaacggaaaaggagggggataacgagtaggaacgagactaccgaagtaactacgtttagtaccg

SEQ ID NO: 341863 - DNA, 529 bp, Homo sapiens
  misc_feature: GZ8MTXP02IZRPO.9.33.C11.1.454.CMB.2.raw
  modified_base (356)..(356): a, c, t, g, unknown or other
  misc_feature (356)..(356): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaactggccaggctccagccctcatcttgatgcatccatcaggccactggcatcccagccaggtcagtggcagtggtctgggacagacttcnctctcaccatcagcagcctagagcctgaatattttgctagtttattactgtacaaactatcgtaccgagtcggccgtccgggggcctacgtttcggcccgtagggaccaaaagttgaagtactacgaaaacgtactagtggctcgacaccaatctgtctcacttctacccgtc

SEQ ID NO: 341864 - DNA, 529 bp, Homo sapiens
  misc_feature: GZ8MTXP02FFZHF.9.33.C11.1.454.CMB.2.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (528)..(528): a, c, t, g, unknown or other
  misc_feature (528)..(528): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctccaggggaaanagccaccctctcctgcagggccagtcagagtgttaccacccagttagcctggtaccaacacaaacctggccaggctcccaggcccctcatctttgatgcatccatcaggccatggcatcccagccaggttcagtggcagtgggtctggggacagacttcnctcncaccatcagcagcctagagcctgaagtatttgctagtttattactgtacaacatcgtaccgagtcggccgtcgggggccctacgtttcggcccgtcgggaaccaaaagttcgaagactacaaacgaaactgtacgctcgcacaatctgtctcactcttcccnc

SEQ ID NO: 341865 - DNA, 570 bp, Homo sapiens
  misc_feature: GZ8MTXP02HA6L9.9.33.C11.1.454.CMB.2.raw
  modified_base (294)..(294): a, c, t, g, unknown or other
  misc_feature (294)..(294): n is a, c, g, or t
  modified_base (369)..(369): a, c, t, g, unknown or other
  misc_feature (369)..(369): n is a, c, g, or t
  modified_base (405)..(405): a, c, t, g, unknown or other
  misc_feature (405)..(405): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagcgccaccctctcctgcagggccagtcagagtgttaccaccagttacgcctggtaccaacacaaacctggccaggcctcccgacgcccctnatcttgatgcatcatcgaggccactggcactcccagccaggttcagtggcaggtgggtctagggacagtacttcnctcctcaccatcagcacgcctagactctagaacgtntttgctagttttactactgtacaaactctacgtaccgtagtcgggtacccggtccggggcctaccgttccggacccgtagggaaccctaaagtcgagtaactacgaaacgtacgtggcgtacgacgcaccaagttctacgttctactaccttccgtaccccgtac

SEQ ID NO: 341866 - DNA, 614 bp, Homo sapiens
  misc_feature: GZ8MTXP02H01GB.9.33.C11.1.454.CMB.2.raw
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcgtggggggggctggtccagccgtgggaggtcctgagactctcctgtgcaggctctggattccaccttcagtaacctacggctgccacgtgggtcccnccaggctccgagggcaagggcttggagtggctgggctaggttgtttacatcgtaggaaggtagttgttacaaattactaanacagaccttcgagaacgggcctatcacatcncaganacatacaaanacacgatgtaanctagacaagtaggaacacgaccgtaagtacggttaggaacggacgtacggtacctttaagttaacgtttaacgtaagggtaaacggtaaaaggacgggggtaataacggaggtacggacgtaacgtcgtaacccgtaagttaccgttacgtttacggtacgttaccgggg

SEQ ID NO: 341867 - DNA, 606 bp, Homo sapiens
  misc_feature: GZ8MTXP02JH6ON.9.33.C11.1.454.CMB.2.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccacctctcctgcagggccagtcagagtgttaccaccagttagcctggtaccaacacaaacctggccaggctcccaggcccctnatcttgatgcatccatcaggccacgtggcactcccagcctaggtcagtcggcnggtggtctgggacagtaccttcactctaccacctatcagcagccctagacncctagaagttntttagctaagttttattactagtactaaactcgtacggtaccggaggtccgggcccggtaccgggggtacctaccggttaccgggacccgtaggggtaaaccctaaagttcgaacgtaacgtacgaaaacggtaacgttggtacggtcgtacgacctaaccgtaattccgttcgttccttacacctttccttccccgtaacc

SEQ ID NO: 341868 - DNA, 531 bp, Homo sapiens
  misc_feature: GZ8MTXP02GLB27.9.33.C11.1.454.CMB.2.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccacccagttagcctggtaccaacacaaacctggccaggcctcccaggcccctcatcttgattcatccatcagggccactggcatcccagccaggttcagtggcaggtcggtctgggacagacttcactctcaccatcagcagcctagagcctagaagtatttgactagtttattactgtacaacatcgtaccgagtcggccgtccgggggcctaccgttcggccgtcggaccaaatagagatacaaacgaactgtagctcgacaccatcgtcgtcttcactcctcccgctac

SEQ ID NO: 341869 - DNA, 574 bp, Homo sapiens
  misc_feature: GZ8MTXP02F0X83.9.33.C11.1.454.CMB.2.raw
  modified_base (447)..(447): a, c, t, g, unknown or other
  misc_feature (447)..(447): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaaagagggggatacgagtggcagcctaccaagtactactttgacttcgtgggggccaggggaaccctggtccacgtctcctcacgccctaccaccaacgggcccatccggtccttcccccgtggcccnccctgcctccgaggcgccaccgtccgaagacgcacgacgccggccgtcggggctcgcccgtggtaccaaaggtacctacgttaccgagtaaccgtaatccacgttcggacggcgggcgtacggaccg

SEQ ID NO: 341870 - DNA, 701 bp, Homo sapiens
  misc_feature: GZ8MTXP02I74T3.9.33.C11.1.454.CMB.2.raw
  modified_base (205)..(205): a, c, t, g, unknown or other
  misc_feature (205)..(205): n is a, c, g, or t
  modified_base (497)..(497): a, c, t, g, unknown or other
  misc_feature (497)..(497): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaancgcccaccctctcctgcagggccagtcagagttcgttaccaccgagttacgccttaggtaacccaaacaaccaaaccgtcggacccaacggccctcccgacggccccctcacttctttgatcgcatccatcgaggccagtggcactcccagccaggttcaggtggctaggtgggtctgggacagtacttcactctacacctatcacgcacgcctagacgtccgtagtaaacgttagttttgacttaagttttactacgtagtaacctaaacgtacgttccggttaaaccggngggttccgggtaccccgggttacccgggggtacccttaccggttttacccggggacccggttaacgggggtaaaacccttaaaaaggttcggaaaacgtaacgtaaaccgtaaaacggtaaccgtaggtacgggtaccttacgaccctaaccggtaattccgttacggttcctttacctaacctttccccgtacccgtaacccg

SEQ ID NO: 341871 - DNA, 693 bp, Homo sapiens
  misc_feature: GZ8MTXP02JZO68.9.33.C11.1.454.CMB.2.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccacctgtctttgtctccgaggggaaangccaccctctcctgcagggccagtcagagtcgttaccacccagttagcctggtaccaacacaaacctggccaggcctcccacggcccctnatctttgatgcatccatcgaggccacgtggcactcccagccaggttcaggtggcaggtcggggtctaggggacaggtaccttcactctaccaccatcacgcacgccctagcgacctaggaaagttacgttttgaccttaagtttttacttacgttacgttaccaaacgttacgttaccggtaaccgtacgggttacgggtcccccgggttacccggggggtcccttaaccgggtttccccggggaccccggttaacgggggtaaacccttaaaaggtttcggaaagttaaccgtaaaccgtaaaaccggtaacggttacggttacgggaccgttacgtacccgtaacctaacgttccttacggttccctttactaccgtttccccgttccccgtacccg

SEQ ID NO: 341872 - DNA, 595 bp, Homo sapiens
  misc_feature: GZ8MTXP02FGB51.9.33.C11.1.454.CMB.2.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctccaggggaaanagccaccctctcctgcagggccagtcagagtgttaccacccagttagcctggtaccaacacaaacctggccaggctcccaggcccctnatctttgatgcatccatcaggcactggcatcccagccaggttcagtgcagtgggtctggggacagacttcactctcacatcagcagcctagagcctagaagtattttgctagtttattactagtacaactatacgtaccgagtcggacccgtccgggggccctaccgtttccggacccgttcggggaaaccctaaaagtttcgaacgtaacgttaaccgaaaacggtaaaaccgtggttacggccgttacggacctaacctaacgttccttacggttcctttacctaactttcctttacctcccg

SEQ ID NO: 341873 - DNA, 628 bp, Homo sapiens
  misc_feature: GZ8MTXP02J1YQ3.9.33.C11.1.454.CMB.2.raw
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctnatctttgatgcatccatcaggccactggcactcccagccaggttccaggtggcaggtgggtctggggacagacttcnctctcaccatcagcagcctagacgcctagaagtatttgctagtttatacttgtacaactatcgacgagtcgggcccggttccgggggcctaccgtttccgggaccccgttagggggaacccctaaaaagtttcggaaaacgttacgtaaaaccgtaaaaccggaaaacgttcgggttacggggtaccttacgggaccctaaaacctaacgttacccttggttacccttttaccaacgtttcccccgtttacccccgtacc

SEQ ID NO: 341874 - DNA, 576 bp, Homo sapiens
  misc_feature: GZ8MTXP02F390E.9.33.C11.1.454.CMB.2.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccaccagttagcctggtaccaacacaaacctggcaggctcccagcccctnatcttgatgcatccatcgacggccacgtggccatccccagccaggttcagtggcaggtggtcngggacagcttcnctcncaccatcagcagcctagacgcctagaagtattttgacttagtttattactgtacaaactactcgtaccgaggtcggccggtccgggggcctaccgtttccgcccgtagggaaaccctaaagttacgagaactaccgaaaacgtacgtaggtcggactacgacctaaccgaattcgtacgtccctttacgtaacttcccttccccgtacc

SEQ ID NO: 341875 - DNA, 629 bp, Homo sapiens
  misc_feature: GZ8MTXP02H2CXO.9.33.C11.1.454.CMB.2.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtgggaggtccctgagactctcctgtgcaggctcgtggattccaccttnagtaacgtacggcgtgcacgtcgggtccnccgaggcctccgaggaccaaggggtcttgggagtggcgtggctagtttgttcatcgtaggaaggtagttgtacaaattactaatacgaagtacctccggtaggaacggtcccgtaattcccacctactcctaccgaagacgaactaacttaccaaagaaacacgtatacgtatactagaactaaagtacggaacacgtacgtaaaggtagttaggacggaaccgtacggtcttaagtttactaacgttaggtaaacggaaaggggaagggggaactacggtagtaggaacgtacgacgtacgtaagtacttacgtttacgtacg

SEQ ID NO: 341876 - DNA, 601 bp, Homo sapiens
  misc_feature: GZ8MTXP02GK6SD.9.33.C11.1.454.CMB.2.raw
  modified_base (445)..(445): a, c, t, g, unknown or other
  misc_feature (445)..(445): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttatactgtacgaaggaggggatacagtgcagcctccaagtactactttgacttcgtgggggccaaggggaaccctggtaccaccgtctccctcacgccctccaaccgaacgggccccagtccggtccttccccccgngggcccgcccctgcctcccgacggaccgccacccttccgacgacgccacgacggcccggcccgtgggccctcggcccgtgggtaccaaacgggtacctaccgttcccgaaggtaccgtaacgtccaaccgtgggacgtcgggggctacggggaccg

SEQ ID NO: 341877 - DNA, 584 bp, Homo sapiens
  misc_feature: GZ8MTXP02HLNM5.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccgccaggctccgaggcaaggggcttggagtggctgggctagtttgtttcatctgaaggtaagtgttcaaattactatccagactccggtagaaacgggccgaatttccacctaatcctaccagacgaacaattaccaagaaacacgatagtatctagactaaagtgaacctagaccctaaaggagtttagagggaacctaacgggcttaggtttaattaacgtggttaaacggaaaagggagggggactaacgaaggtggcgagctaccaagtactactttagtaccg

SEQ ID NO: 341878 - DNA, 608 bp, Homo sapiens
  misc_feature: GZ8MTXP02J06Y9.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaanagccaccctctcctgcagggccagtcagagtgttaccaccagttagcctgtaccaacacaaacctggccaggcctcccaggcccctnatcttgatgcatccatcgacgggccacgtcggcactccccagtcccaggtttacaggtcgggcagggtcggggtcgtggggacaggtaccttcnctctaccacatcagcagcctagncctagaatgtttgctagtttatactgtacactatacgtacgagtcgggtcccgtccgggggcctacgttccggacccgtacgggaaacctaaagttcgaacgtaactaaccgaaaacggtaaccgtaggtacggtactacggacctaaacccgaattaccgttacgttcccttaactacccgttacctttccccgtacccg

SEQ ID NO: 341879 - DNA, 555 bp, Homo sapiens
  misc_feature: GZ8MTXP02GACRK.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtgggtcccgccaggcctccaggccaaggggcttggagtggctggctagttgttcatctgaaggagttgttacaatactatcagactccgtagaacgggcattccacatcctaccagagacaacttccaaagaacacgatgtatctagacaaatggaacagacctaagacgttagaacggacgacggtcttagtttacttacgtaggtaacggaaagggaacgggggtataacgagtggaacgagactacaagtactacttacgtacg

SEQ ID NO: 341880 - DNA, 574 bp, Homo sapiens
  misc_feature: GZ8MTXP02F80JX.9.33.C11.1.454.CMB.2.raw
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttcagtaactacggcgtgcacgtgggtcccnccaggcctccgaggcaaggggcttggagtggctggctagttgttcatcngaaggatgttacaatactatacagactccgtgaacgggccattccacatcctcagagacaataccaaagaacacgatagtatctagacaaatggacagacctaagagttagaggacacggtcttagtttattacgtagtaacggaaaaggagggggtaataacggaaggtaggacgagtacgtaaccgtaaacgtaacttacgtttacgtacgtttcggtacggggtaacccgg

SEQ ID NO: 341881 - DNA, 647 bp, Homo sapiens
  misc_feature: GZ8MTXP02G7J0N.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctcgtggattccaccttcagtaacctacggcgtgcacgtcgggtccgccaggcctccgaggcgaagggtcttggagtggctggctagttgttcagtctaggaaggtagttgtacaatactatacgagtactccggtaggaacgggccgtacttaccgaccactccctacgaaggaacaactaaacttacccaaagtaaaccacgtatagtaatcgtagactaaagtcggaacacgtaaccgtaaagacggttaggaacggtaaccgtacggtacgtttagtttaacgtaaccgtagggtaaacggaaaaggggtaagggggtaactaacggaggttacggaacgaacgtacccgtaactaaacggttacctttacggtttacgtttaaccgg

SEQ ID NO: 341882 - DNA, 667 bp, Homo sapiens
  misc_feature: GZ8MTXP02HGS4B.9.33.C11.1.454.CMB.2.raw
  modified_base (348)..(348): a, c, t, g, unknown or other
  misc_feature (348)..(348): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcaagtaactacggcgtgcacgtgggtcccgccaggcctccgaggcaaggggcttggagtggctggctagttnttcatcgtagaggtagtgttacaattactatacagaccgtccgtagaacgggcctattccaccattccaccgagaacgactaaacttaccgaaacgaaaccacgattagtactactacggactaaaagtcgggaactaacgaccgtaaaggtaggtttacggaacgggtaaccgtaacgggtaccgtttaggttttaaacgttaccggttaaacgggttaaaaccgggaaaagggggtaacggggggtaaacttaaccggaggttaacgggacgtaacggtacctaaccgtaaacgttaaccgtttacgtttaaccggg

SEQ ID NO: 341883 - DNA, 603 bp, Homo sapiens
  misc_feature: GZ8MTXP02H4CP4.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggaggtccctgagactctcctgtgcaggctctggattcaccttcagtaactcggctgcacgtgggtccgccaggcctccgagggccaaggggcttgggagtggctgggctaggtttgtttcatcgtagaaaggacgttgttacaatacttatacagcctccgtagaacggggcctaattcccaccatcctccagagactaaacttacccaaagaacacgatgtatctagactaaagtggacagaccgtaaaggagttagacggacgtacggtacgttagttttaacttagtaggttaaacggaaaaggggaacgggggtataacggtaggtaggaacgacggtactaccgaaacgttacttaacgtttacgtaccg

SEQ ID NO: 341884 - DNA, 572 bp, Homo sapiens
  misc_feature: GZ8MTXP02HQJWQ.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccaggcaagggcttggagtggctggctagtttgttcatcgtaggaaggaagtgttacaatactatacgagtactaccggtagaacgggccgtattcacccatacctaccagagaactaattaccaaagaacacgatagtactactagacaaagtgacagacctaagagtagaggacacggtacttagttaatacgtagtaacggaaaggagggggtatacgagtaggcaagactactaacgtactacgtttacgtacgtttcgg

SEQ ID NO: 341885 - DNA, 668 bp, Homo sapiens
  misc_feature: GZ8MTXP02JDTRL.9.33.C11.1.454.CMB.2.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtgttaccaccagttacgcctggtaacccaacacaaacctggccaggcctcccaggcccctnatcttgatgcatccatcagggccagtggcatcccagcctaggttcaggtggcaggtgggtctggggacagtaccttcnctctcaccatcagctacgcctagacgtcctaggaagttattttgacttaagtttttacttacgtcgtaacgtaaactattaccggtaacccggtaggttccgggtccccggttacccgggggtacccttaccggttttccccggggacccgttacggggaaacccctaaaaggtttcgaaacgtaacgttaaccgaaaaccggtacgttacgggttacggacgttcggaccctaaacccgttaacgttccgttacgttaccctttaccgtacccgtttccccgttaccccgtaccg

SEQ ID NO: 341886 - DNA, 614 bp, Homo sapiens
  misc_feature: GZ8MTXP02JGEVR.9.33.C11.1.454.CMB.2.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaaccctggccaggcctcccacggcccctcatcttgatgcatccatcgaggccatggcactccccagccaggttcagtggcaggtgggctgggacngacttcactctcacatcagcancctagacgcctagaagttntttagacttagttttaacttactagtacaaactagttccgtaaccggtgtccgggtcccggtcccgggggtaccctaccggtttcccggggacccgtacggggaaaccctaaaagtttcggaaacgtaactacgaaaacgtaaccgttggtacggcgtacgccgtaacctaacgttccgttcgttccttactacctttcccgtaccccggttcc

SEQ ID NO: 341887 - DNA, 587 bp, Homo sapiens
  misc_feature: GZ8MTXP02G4MCW.9.33.C11.1.454.CMB.2.raw
  modified_base (299)..(299): a, c, t, g, unknown or other
  misc_feature (299)..(299): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacgggcgtgcacgtgggtcccnccgaggcctccgaggcaaggggcttgggagtggctgggctaggtttgtttcagttcgtaggaaaggtagttgttacaaattactaatacagactccggtagaacgggtccgattccaccatcctaccagagaacaataccaaagaacacgatgtatctagacaaagtcggaacagacctaaagagttaggaaggacgacggtcttagtttaacttacgtaggtaaacggaaagggagggggtactacgaggtacggaacgagactacgaagtactacgtttacgtacg

SEQ ID NO: 341888 - DNA, 614 bp, Homo sapiens
  misc_feature: GZ8MTXP02GVI1B.9.33.C11.1.454.CMB.2.raw
  modified_base (299)..(299): a, c, t, g, unknown or other
  misc_feature (299)..(299): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctctggattcaccttcagtaactacggcgtgcacgtgggtccnccaggcctccgaggcaagggcttggagtggcgtggctagttgtttcagttcgtaggaaggtagttgttacaagttactaatacgagtacgtccggtagaacggggtccattaccaacctactcctaccaaggacaacgtaaacttaccaaaacgtaacaacgattagtaactcgtagactaaaagtcggaacacgacctaaaggagttaggaacggtactacgggtcttagtttaactacgtaggtaaacggaaagggtacggggaactaacgaggtggaacgacgtacgtactaagtacttacgttagtaaccg

SEQ ID NO: 341889 - DNA, 677 bp, Homo sapiens
  misc_feature: GZ8MTXP02G3FBL.9.33.C11.1.454.CMB.2.raw
  modified_base (302)..(302): a, c, t, g, unknown or other
  misc_feature (302)..(302): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcggtggggggggctggtccagcctgggagtccctgagactctcctgtgcaggctcgtggtacttcaccttcagtaaactcggcgtgcacgtcgggtccnccgaggcctcgaggcaaggggtcttggaggtggcgtggctagttgttcattcgtaggaaggtagttcgtactaatactataccgagtaccgtaccggtagaacggggtcctaattcccaacctatccctacaacgaacgtaacctaacttacccgaaagaaaccgacgtaagtacgtagtacctagaacgtaaagtacggaacagtaaccgtaaggtacgttaggaacggtacgtaacggtacgtttacgtttaacgttaacgtaacggttaaacgggaaaaggggtacgggggtaaacttaaccggaagggttacgaaccgtacggtaacctaacccgttaaaggttaaccctttaagtttacgttaacccggg

SEQ ID NO: 341890 - DNA, 724 bp, Homo sapiens
  misc_feature: GZ8MTXP02GJ4WX.9.33.C11.1.454.CMB.2.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtcttgctccaggggaangccacctntcctgcagggccagtcagagtgttaccaccagttacgcctggtaccaacacaaaccgtggccaggcctcccaggcccctnatcttgatgcatccatcgaggccacgtggcactccccagcctaggttcagtcggctaggtcgggtctaggggacnggtacctttcaccgttcctaccaaccctatccaagctaacgaccctaagacgtcccgtaggaaacgttatttttacgacttaaggttttaacttacgtacgttaccaaacgtacgttaccggtaaaccggtggtaccgggtcccgggttaccccgggggcccttaaccggtttcccgggaaccccgttaccggggtaaacccgttaaaaaggtttcgaaaacggtaaacgttaacccggaaaaaccggtaaaccgttagggtacggggtaccttaacgggacccctaacccggtaactttacccggttaccggtttaccgtttacccgtaaaccgtttccccttttacccccggtaaacccg

SEQ ID NO: 341891 - DNA, 544 bp, Homo sapiens
  misc_feature: GZ8MTXP02H2G6Q.9.33.C11.1.454.CMB.2.raw
  modified_base (299)..(299): a, c, t, g, unknown or other
  misc_feature (299)..(299): n is a, c, g, or t
  modified_base (376)..(376): a, c, t, g, unknown or other
  misc_feature (376)..(376): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgcacgtgggtccnccaggcctccgaggcaaggggcttggagtggctggctagtttgttcatcgtagaaggtagtgttacaatactatacngactcgtagaaggccatcacactctccagagacaattaccaagaacacgaatgtatctagacaaatggacagacctaagagtagaggacacggtctagtttactacgtagtaacggaaaggagggggaatacgagtagcaagctacacgtactacgtttagacttcgg

SEQ ID NO: 341892 - DNA, 563 bp, Homo sapiens
  misc_feature: GZ8MTXP02F6UUD.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaaggccattcaccatctccagagacaattccaagaacacgatgtatctgcaaatggacagcctaagagttgagacacggctgtttatactgtacgaagaggggatacgagtgcagcctcaagtactacttgacttcgtggggccacgggaacctggtcaccgtctcctcacgccctccaccgaacgggccctaagtcccggttccttccccccgtgggcccgtcccctcggccctccgacggacgcccaccgtccgacgacgcacgacgccggccctggggcctcggcccgtggtccaaacggactacctccgagacgtaatcacgtcgacgcggctggacg

SEQ ID NO: 341893 - DNA, 574 bp, Homo sapiens
  misc_feature: GZ8MTXP02JNL72.9.33.C11.1.454.CMB.2.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtgttaccaccagttagcctggtaaccaacacaaacctggccaggcctcccaggcccctnatcttgatgcatccatcgaggccactggcactcccagccaggttcagtggcaggtggtctgggacngacttcnctctcaccntcagcagcctagacgcctagaacgtattttgctagtttactactagtacaactatacgtacgagtcgggccgtccgggggcctacgttccggcccgtagggaacctaaaagttcgaagtactacgaaacgtaacgtggtacggctacggaccaacctaagttcctcgttaccttacgtaactttcccgttaccccgtacc

SEQ ID NO: 341894 - DNA, 619 bp, Homo sapiens
  misc_feature: GZ8MTXP02FS2S5.9.33.C11.1.454.CMB.2.raw
  modified_base (388)..(388): a, c, t, g, unknown or other
  misc_feature (388)..(388): n is a, c, g, or t
tcagtgatacgtctcacgaccggtgctcgatttagagtgagctcgtggggagaggagcccagcactagaagtcggcggtgtttccattcggtgatccagcactgaacacagaggactcaccatggagtttgggctgagctgggttttcctcgttgctcttttaagaggtgtccagtgtcaagtgcaactggtggagtcgtggggggggcgtggtccagccgtgggacggtccctgagactctccgtgtgcaggctctggattctacctttcagtaactacggcgtgacaacgtcggggtcccgccaggcctccgaggccaagggtcttgggagtggctggctagttgtttcatcgtagaaggtagtgttacaatactatacagctcgngaaacggcctattcacatctcagagacaatcaaagacacgatgtactctagactaaagtacggaactaacgtacctaaagtaacggttaggaacggtaacgtaacggtactttagtttaacgttaacgttacggttaaacggaaaaggggtacgggggaaattacggaaggtacggacgaacggtaacctaccgaaagttacctacgtttacggtaacgttcggtacgggg

SEQ ID NO: 341895 - DNA, 629 bp, Homo sapiens
  misc_feature: GZ8MTXP02G6GYM.9.33.C11.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtcgttaccacccagttacgcctggtaccaacacaaacctggccaggctcccaggcccctnatcttgatcgcatccatcaggggccagtggcactcccagcctaggtcagtggcaggtggggtctggggacagtacttcnctctacaccatcagcacgcctagacgcctagaacgttattttaggcttaagttttacttactagtacaaactagttaccgtaccgtagggtccggcccgggttacccgggggaccctacggtttacccggccggttacgggaaccctaaaagttcgaacgtaacgtaacgaaaaccggtaacgttcggtacgggactacggtacccaacccgtaattcccgttacgtttacccttacgtacctttcccgtacccgtac

SEQ ID NO: 341896 - DNA, 596 bp, Homo sapiens
  misc_feature: GZ8MTXP02J0IYP.9.33.C11.1.454.CMB.2.raw
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (402)..(402): a, c, t, g, unknown or other
  misc_feature (402)..(402): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaanagccaccctctcctgcagggccagtcagagtgttaccaccagttagcctggtaccaacacaaactggccaggctcccaggcccctcatcttgatgcatccatcagggccacgtggcactcccagccaggttcaggtggcaggtgggtctggggacagacttcnctctcacatcagcacgcctagacgcctagaagtntttgcttagtttattactgtacaaactagtacgtacggtagtcgggcccggtccgggggcctaccggtttccggcccgtagggaaccctaaaagttcggaacgtaacgtaccgaaaacggtaacgttacggtacggtacgacggtaccaccgtcgtacgttacgttccttactacttcccgtttacccgtaccg

SEQ ID NO: 341897 - DNA, 728 bp, Homo sapiens
  misc_feature: GZ8MTXP02H62OZ.9.33.C11.1.454.CMB.2.raw
  modified_base (307)..(307): a, c, t, g, unknown or other
  misc_feature (307)..(307): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtgggggggggcgtggtccagcctggggaggtccctgagactctcctgtgcaggctctggattcaccttcagtaactacggcgtgcacgtcgggtccnccaggcctccgaggcgaaggggcttggagtgggctgggctaggtttgtttcatcgtaggaaagggtaagttgttacaaattacttaataacaggaccttacccggtagggaaacggggtcccgtaatttcccgaaccctacttcctacccaaagaacgaaacctaaactttaacccgaaaacgaaacaacgtaattagtaacttacttacgaactaaaacgtcgggaactacggaccgtaaaggtaggttaggaacgggtaaaccgtacgggtacgtttaggttttaacgtttaaacgttacgggttaaaccgggtaaaagggggtaaacggggggtaaacgtaacggtaacgggttggaccgtaaggtaccgtaaccgtaaacggttaacctttaccgttttacggtacgtttaccgggg

SEQ ID NO: 341898 - DNA, 638 bp, Homo sapiens
  misc_feature: GZ8MTXP02HV6HN.9.33.C11.1.454.CMB.2.raw
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (468)..(468): a, c, t, g, unknown or other
  misc_feature (468)..(468): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgngngtctgtgtctctctagtactaacgcgngcncaggtcggccacgcgcncgngagaggtgtaggngtcgngtcgngttagtttctatgtcgtaaggaaggtagttcgtaactaacttactaactaacgcgtaccgtacggtaaggaccgggtactacttaccactctccacgagaactaaatctaaacgaacacgagtatagtactcgtaanaaacgtagacgacgtacgtaacgtaggtaggaacggaacgtacgtacgttagttttaagttaacgtacggtaaaacgggaaagggtaaacgggggtacggtaaactacgggtcggacgacgtaacgtaccgtaaacgttaacttactttacggtacgttccggtacgggg

SEQ ID NO: 341899 - DNA, 697 bp, Homo sapiens
  misc_feature: GZ8MTXP02H7N48.9.33.C11.1.454.CMB.2.raw
  modified_base (306)..(306): a, c, t, g, unknown or other
  misc_feature (306)..(306): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccaccggagagattgtgttgacacagtctccagccaccctgtcttttgctccgaaggggaagagcccaccctctcctgcagggccagtcagagtcgttaccacccagttacgcctaggtacccaaacaaccaaaccgtcggaccaggcctccccgaggccccctnatctttgatgcatccatcaggccagtggacactcccagccaggttacaggtcggctagggtgggtcgtaggggacacggtacctttcaccgttcctacaacccgtatccgacgccacgtacccgttaaggacgtcccgttaagtaaaggttagtttttacgtacgttaacgttttattaaaccgttgtacctaaactagttaccgtaacggtagtccggtcccggttacccgggggtccctaccggttcccgggtacccgtaacggggtaaacccaaaagtttcggaaacgtaacgtaaccgtaaaacggtaacctagggtacggtcctacggacctaccgtaacgttccgtaacgttccttaccgtacctttcccgtttaacccccgtcg

SEQ ID NO: 341900 - DNA, 567 bp, Homo sapiens
  misc_feature: GZ8MTXP02GKS2Q.9.33.C11.1.454.CMB.2.raw
  modified_base (201)..(201): a, c, t, g, unknown or other
  misc_feature (201)..(201): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccggagagattgtgttgacacagtctccagccaccctgtctttgtctccagggaaangccacctctcctgcagggccagtcagagtgttaccaccagttagcctggtaccaacacaaacctggccaggctcccaggcccctcatctttgatgcatccatcaggccactggcatcccagccaggttcagtggcagtgggtctgggacagacttcactctcaccatcagcagcctagagcctgaagtattttgactagtttacttactagtacaaactataccgtaccgagttcggcccggttccgggggccctaccgttccgggccccttaggggaaccctaaaagttgaacgtactacgaaacgtaaacgtgtacggtctacggccactaagtcctagttccttactacttccgttccgaccc

SEQ ID NO: 341901 - DNA, 573 bp, Homo sapiens
  misc_feature: GZ8MTXP02JHHVZ.9.33.C11.1.454.CMB.2.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
  modified_base (354)..(354): a, c, t, g, unknown or other
  misc_feature (354)..(354): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccaggggaaangccacctctcctgcagggccagtcagagtgtaccaccagttagcctggtaccaacacaaactgccaggctccagcccctnatcttgatgcatccatcacggccactggcactcccagccaggttcagtggcagtggtctgggacagacttcnctctcaccatcagcacgacctagacgcctagaacgtatttgctagttttattactgtactaactatacgtacgtaggtcggtcccgtccgggggcctaccggtttccggacccgtacgggaaaccgtaaaacgttcgaacgtacttaccgaaaacgtaaaccgtgtacggtctacggaccaccgtaagtcttacgttcttctacttccgttcccgtacc

SEQ ID NO: 341902 - DNA, 575 bp, Homo sapiens
  misc_feature: GZ8MTXP02JWZCU.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggggctggtccagcctgggaggtccctgagactctcctgtgcaggctctggattcaccttcagtaactacggcgtgcacgtggggtcccgccaggcctccgaggcaaggggcttggagtggctggctagttgtttcatctagaaggtagtgttacaatactatcagactccggtagaacgggcgattccacctatcctccagagaacaattaccaaagaacacgatagtatctagacaaatggacagacctaaggagttaggaggacacggcttagtttacttacgtaggtaacggaaaagggagggggaatacggaggtcggaacgtacgacgtaccgtaagttaccttacgtttacgtaccgg

SEQ ID NO: 341903 - DNA, 582 bp, Homo sapiens
  misc_feature: GZ8MTXP02GLUNC.9.33.C11.1.454.CMB.2.raw
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggaggtccctgagactctcctgtgcaggctctggattcaccttcagtaactacggcgtgccacgtgggtcccgccaggcctccgaggcaaggggcttggagtggctggctagtttgttcatcgtaggaaaggtagtcgttacaaatactaatacagactccggtagaaacgggcctattccaacctatcctaccagacgaacaattaccaaagaacacgatagtatctagacaaatggacagacctaagagtagacgacacgtctagtttatacgtagtaacggaaagggagggggactaagacggtagacgagtaccgtaacgtaacgttacttacgttagtacgttcggtacggaaccgg

SEQ ID NO: 341904 - DNA, 547 bp, Homo sapiens
  misc_feature: GZ8MTXP02IVQUN.9.33.C11.1.454.CMB.2.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (519)..(519): a, c, t, g, unknown or other
  misc_feature (519)..(519): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggccaggctcccaggcccctnatcttgatgcatccatcgaggccacgtggcatccccagccaggttcagtggcaggtgggctgggacagtaccttcactctcaccatccagcagccctagacgcctgaagtatttgctagtttattactgtacaaactctacgtaccgagtcggccggtccgggggcctacgttccgggcctagggaccaaagttgaagactacaaacgaactgtacggctcgaccactntacttcgtctttactccttcccgactac

SEQ ID NO: 341905 - DNA, 724 bp, Homo sapiens
  misc_feature: GZ8MTXP02JSZAH.9.33.C11.1.454.CMB.2.raw
  modified_base (377)..(377): a, c, t, g, unknown or other
  misc_feature (377)..(377): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggcgtggtccagccgtgggaggtccctgagactctcctgtgcaggctctggattcaccttcaagtaactacggcgtgcacgtgggtccgccaggcctccaggcaagggcttggagtggcgtggctagttgttcatcgtagaaggtagtgtacaattactanactagacctccggtagaacgggccgtattaccaccagtacctacccgaagacgaactaaacgttaccaaacgaaacgaaacgtatacgtaatacgttacgaaacgtaaacgtagggaaaccacgggtaaccctaaaagggtaacggtttaggaaacggggtaaacgtacccgggttacgttttaaggtttaaacgttaaaccgggttaggttaaaaccggggtaaaacggggtaaagggggggtaaactaaaccgggtaaggggttacggaaccgtaacgtacccggtaaaccccgtaaaaggtttaccgtttaaaccgttttcggtaaaccggttttacccggggg

SEQ ID NO: 341906 - DNA, 604 bp, Homo sapiens
  misc_feature: GZ8MTXP02HLAMG.9.33.C11.1.454.CMB.2.raw
  modified_base (452)..(452): a, c, t, g, unknown or other
  misc_feature (452)..(452): n is a, c, g, or t
tcagtgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcacatctccagagacaattccaagaacacgatgtatctgacaaatggacagacctaagagttgaggacacggctgtttattactagtacgaaagagggggatacgagtggcagcctaccaagtacttactttgacttcgtcggggccgagggaccctggtccaccgtctccctcacgccctacccaccgaacgggccccagtcccggtccttcccccgngggcccgcccttgccctccgacggtacgccacccgtccgagacgcacgacggcccggcccgtggggcctcggcccgtggtaccgaaacgggtacctaccgttaccaagtaccgtaacacgtaacgtcggaacgccggggtcgtacggaccgg

SEQ ID NO: 341907 - DNA, 686 bp, Homo sapiens
  misc_feature: GZ8MTXP02IJ7EJ.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcggtggggggggctggtccaggccgtgggacgtccctgagactctcctgtgcaggctcgtggtacttccaccttcgaagtaacgtacggcgtcgctacggtcgggtccccgccgaggcctaccggaggcgaaacggggtcgttgggaggtcggcgtggtctaggtttcgttcaagtcgtaggaaggtattgttacaattactaatacgacgtactccggtagaaccgggtccgtaattacccgaacctactaccctacgaagaacgtaaactaaacttacccgaaaagaacaacgattaggtaacttcgtagaacctaaagtcggaacgaacgtaccgtaaaggtagttacgaaggtaacgtacggtacgttagttttaacgtacgttaaggtaaacggaaaaggggtaacgggggtactaacggtagtacggaacgtacgtacctaccgtaaacgtttaccgtttaacgttacgttaaccgg

SEQ ID NO: 341908 - DNA, 588 bp, Homo sapiens
  misc_feature: GZ8MTXP02G263Q.9.33.C11.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccgaggggaaancgccaccctctcctgcagggccagtcagagtcgtaccacccagttacgcctggtaccaacacaaacctggccaggcctcccaggcccctnatctttgatgcatccatcaggccagtcggccactccccagcctaggttcgaggtggcagggtgggctgggacagacttcnctcncacntcagcacgctagacgacctagaatgtttgacttagtttattactgtacaacgtacttacgtacgtagtccggccggtaccgggggtccctacgttcggcccgtacggaacctaaagtacgaacgtactaaccgtaaacgacgttaggtcggtacgtacgaccgaacctaagttcgtcgttaccttactactttcccttacccgtacc

SEQ ID NO: 341909 - DNA, 615 bp, Homo sapiens
  misc_feature: GZ8MTXP02FZ7FS.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggcgtggtccagccgtggggaggtccctgagactctcctgtgcaggctctggattccaccttcagtaactacggcgtgccacgtgggtcccgccaggcctccgagggcgaaggggcttgggagtggctgggctaggtttgtttcatcgtagaaggtagttgttacaaatactatacagtacctccggtaggaaacgggcccgtaattccaacctactcctacccgagaacgaactaaacttacccaaagaaacaacgatacgtatactagacaaagtagacagaccgtaaagacgtagacgacgacgtacttagtttaacttacgtagtaacggaaagggagggggtactacgaggtggacgaacgactacgtaacgtacttacgttacgtacgttcgg

SEQ ID NO: 341910 - DNA, 580 bp, Homo sapiens
  misc_feature: GZ8MTXP02FKNOA.9.33.C11.1.454.CMB.2.raw
tcagtgatacgtctcacgaccggtgctcgatttagagtgagctcgttgggtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaacgtacggcgtgcactgggtccgccaggctccaggcaaggggcttggagtggctggcagttgtttcatctgaaggagtgttcaatactatacagactccgtgaaggccgattcacatctccagagacaattccaaagaacacgatgtatctgaccaaatggacagcctaaggagttgaggacacggtctgtttaattactagtaacgaaaggagggggatacgagtggacagctacaagtacttactttgtacgttcgtcggggccgacgggaacccgtggtccgaccgtctcctcacgcctaccaccgaacggccctacgtcccggtcccttccccgtcggtcccgccctcgccgtccgacggacgccgacccgtaccgacgaccg

SEQ ID NO: 341911 - DNA, 587 bp, Homo sapiens
  misc_feature: GZ8MTXP02IGZBQ.9.33.C11.1.454.CMB.2.raw
  modified_base (413)..(413): a, c, t, g, unknown or other
  misc_feature (413)..(413): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctcgtggtattcaccttcagtaacctacggcgtgccacgtcgggtccgccaggcctccgagggcaagggtcttggagtggctggctagttgtttcatctaggaaggaagtgttacaatactatacagtactccgtaggacggcctatcaccactcnccagagaacaattaccaaagaacacgatagtatactagacaaagtcgacagtacctaagagttagaggacacggtacttagttaattacgtagtaaacggaaagggtaagggggaatacgacggtggacgaagtacctaacgtaacgttacttacgtttacgtacgtttacggg

SEQ ID NO: 341912 - DNA, 590 bp, Homo sapiens
  misc_feature: GZ8MTXP02G2E5Y.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggcgtggtccagccgtgggaggtccctgagactctcctgtgcaggctctggattcaccttcagtaactacggcgtgcacgtgggtcccgccgaggcctcccgagggcgaaggggtcttgggagtgggctgggctaggtttcgtttcagttcgttaggaagggtaagttgttacaattacgtaatacagacctccggtagaacgggccgattcaccatctaccagagacaataccaagaacacgatacgtatactagacaagtgacacgacctaaagagttagacggacgacggtacttagtttaacttacgtagtaaacggtaaaggagggggaatacgagtggacaagctacgtagtacttacttgtacgtttcgg

SEQ ID NO: 341913 - DNA, 775 bp, Homo sapiens
  misc_feature: GZ8MTXP02IW6DH.9.33.C11.1.454.CMB.2.raw
tcagtgatacgtctcacgaccggtgctcgatttagagtgagctcgtggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtggggggggcggtggtccgaggccgtggggacgggttcccgtggacgtacgtccgttcccttggtcgcgtagggccttcgtcgggtactttccgaaccctttcaacgttaaacctacgggtcgtgcgtacgtcgggtcccgccgaacggcctccgacggcgaaggggtcgttagggacggtgggcgtgggcgtaggtttcggtttacatcgtaggtaaaggtacggttgtacaaatacgtaatacgaagtaccgtaccggttaggaacggggaccgtactttacgaacctacttacccgtaccaagacgaacctaaacttaacccgaaagaaaccaacgtaacgtaagtactacgttaacgacctaaaacgtacgtaaacgacgtacccgtaaaggtacggttaacggaacggaacgtaacggggtccttaagtttaacgttacggtaaaggtaaacgggtaaaagggtaacgggggtaaacttaaacggtaggtacggtacggaaacggtaaccgtaacccgtaaaaggttaccccgtttaaagtttaccggtaacgtttacggtaaccggggg

SEQ ID NO: 341914 - DNA, 568 bp, Homo sapiens
  misc_feature: GZ8MTXP02GUGSR.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcacatctccagagacaattccaaagaacacgatgtatctgacaaatggacagacctaagagttgaggacacggctgtttatactagtaacggaaaggagggggatacgagtggcagcctacaagtactactttgacttgcggggccacgggaacctgtccaccgtctccctcacgccctaccgaccgacgggcccagtcccggtccttcccccgtggcccgccctgcctaccgacggacgcccaccgtccgagacgcacgacgccggccgtcgggctcgccgtggtacaacggactaccgtccagtacgtaactccgacgtgacggcggtcaggacg

SEQ ID NO: 341915 - DNA, 679 bp, Homo sapiens
  misc_feature: GZ8MTXP02HDB7P.9.33.C11.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (428)..(428): a, c, t, g, unknown or other
  misc_feature (428)..(428): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtgttaccacctagttacgcctggtaaccaacacaaacctggccaggcctcccagcccctnatcttgatgcatccatcgacggccacgtgcactcccagccaggttcagtggcaggtgggtcgtagggacagtaccttcaccttctacaaccctatccgaacgccacggaccctaggaccgtccgtaggaaagttntttttacgaccttaagtttttaacttacgtagttaccaaactacgttaccggtaaccgtaggtcccgggtcccggtaccccgggggtaccttaccggtttcccgggacccgtaggggtaaaccctaaaagttcgaaagtaaccgtaaaccgaaaacgtaacgtcgggttacgaccgttacgacccctaaaccgttaacgtttccgttaccgtttaccttaccgttaccctttacccccgttaccccaaccg

SEQ ID NO: 341916 - DNA, 614 bp, Homo sapiens
  misc_feature: GZ8MTXP02GYC3C.9.33.C11.1.454.CMB.2.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcagggccagtcagagtgttaccacctagttacgcctggtaccaacacaaacctggccaggcctcccaggcccctnatcttgatgcatccatcgaggccacgtggcactcccagcctaggttcaggtcggcaggtcgggtctggggacaggtaccttcnctctacacctatccaagcacgccctagacgtacctaggaaagttnttttagacttaagtttaacttactacgtacaaacgtnttaccggtaccgtagtccgggtacccgggtccgggggtacctaccggtttccgggacccgttacggggaaccctaaaagttcgaaagtaactacgaaaacggtacgtggtacggctacgcctacaacgtcgtacgtcttacacttcctacccgac

SEQ ID NO: 341917 - DNA, 529 bp, Homo sapiens
  misc_feature: GZ8MTXP02FUAKO.9.33.C11.1.454.CMB.2.raw
  modified_base (287)..(287): a, c, t, g, unknown or other
  misc_feature (287)..(287): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctccaggggaagagccaccctctcctgcagggccagtcagagtgttaccacccagttacgcctggtaccaacacaaactgccaggcctccaggccctnatcttgatgcatccatcaggcactgcatcccagccagtcagtggcaggtgggtctgggacagacttcnctcncaccatccagcagcctagacgcctagaagtattttgacttagtttatactagtacaactatcgtaccgagtcggccgtccggggcctacgttcggcccgtagggaccaaagtgaacgactacgaaacgacgtgtagctacgcactaatctcgtctcgtactccttaccgc

SEQ ID NO: 341918 - DNA, 558 bp, Homo sapiens
  misc_feature: GZ8MTXP02GFE0N.9.33.C11.1.454.CMB.2.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgtagggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttnagtaactcggcgtgcactgggtccncaggctccaggcaagggcttggagtggctggctagtttgttcatctaggaaggagtgttacaatactatacagactccgtagaacgggccattccaccatctacagagaacaatccaaagaacacgatgtatctagacaaagtggacagacctaagagttaggaaggacgacgtcttagtttaatacgtaggtaaacggaaagggaacgggggtatacgagtaggaacgtacgactaccgaagttacctacgtttacggtacg

SEQ ID NO: 341919 - DNA, 537 bp, Homo sapiens
  misc_feature: GZ8MTXP02GNW51.9.33.C11.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaanagccaccctctcctgcagggccagtcagagtgttaccacctagttagcctggtaccaacacaaacctggccaggctcccagcccctnatctttgatgcatccatcgaggccatggcatcccagcccaggttcagtgcagtggctgggacagcttnctctcaccatcagcacgcctagacgcctagaagattttgctagtttattactgttacaaatctacgtacgagtcggccgtccgggggcctacgttcggcccgtacgggacctaaagttcgaagacgtacaaaacgtactagtcggctacgcacaacgtctcgtcttcactccttccctcc

SEQ ID NO: 341920 - DNA, 642 bp, Homo sapiens
  misc_feature: GZ8MTXP02JH89O.9.33.C11.1.454.CMB.2.raw
  modified_base (308)..(308): a, c, t, g, unknown or other
  misc_feature (308)..(308): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtggggggggcgtggtccagccgtggggacggtccctgagactctcctgtgcaggctctggattcaccttcaagtactacggcgtgcacgtcgggtccncgaggcctccgagggcaaggggtctgggagtcggctgggctaggttgttcatcgtagaaggtagtgttacaaatctaatacagtactccggtaggaacgggccgtattaccactactctacagagacaattacaaagaacaacgtatagtactacgtagaactaaagtacggaacacgtaacctaaggtacgttaggaacggtacgtacgggtacgtttagtttaacttaaccgttaaggtaaacgggtaaaacggggtagggggaaacttacggaaggtcggacgaacgtaccgtacgtaaacgttacttacgtttacgtacgtttaccgggg

SEQ ID NO: 341921 - DNA, 593 bp, Homo sapiens
  misc_feature: GZ8MTXP02IT64S.9.33.C11.1.454.CMB.2.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttagcctggtaccaacacaaacctggccaggcctcccaggcccctcatcttgatgcatccatcacggccactggcactcccagccaggttcagtggcaggtggtctggggacagtacttcactctcaccntcagcacgcctagacgctagaagtatttgctaagtttacttactgtactaaactacgttccgtacgtagtcggtcccggtcccgggggtcctaccggtttccgggacccgttacgggtaaccctaaaagttcgaaacgtacgtaaccgaaaacgtaacgtcggtacggactacggacctacctaattctacgttccttacctacttcccttcccgtacc

SEQ ID NO: 341922 - DNA, 573 bp, Homo sapiens
  misc_feature: GZ8MTXP02GHB35.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctggggaggtccctgagactctcctgtgcaggctctggattcaccttcagtaactacggcgtgcacgtgggtcccgccaggctccaggcaagggcttggagtggctggctagttgttcatctggaagagtgtacaatactatacagacctccggtaggaacgggcccgtaatttccgacctatcctacccgagagaacaattaccaaagaacacgatagtatctagacaaatgacacgacctaagagttagaggacacggtctagtttacgtactaggtaacggaaagggagggggatacgaggtggacgaagcgtacgtaacgtactacgttacgtacgtttacgg

SEQ ID NO: 341923 - DNA, 702 bp, Homo sapiens
  misc_feature: GZ8MTXP02HCM9A.9.33.C11.1.454.CMB.2.raw
  modified_base (204)..(204): a, c, t, g, unknown or other
  misc_feature (204)..(204): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanacgccaccctctcctgcagggccagtcagagttcgttaccacctagttacgccttaggtaacccaacaaccaaaccgtggacccaggccctacccgacggcccctacacttctttgatcgactactccatccgacgggccacgtcggcactcccagccaggttccagtggcaggtggtcgtagggacagtacttcgacctctacaacctataccgacgtcacgtacccgtaagaacgtcctaaggtaaacgttagtttttacggacctttaaggtttttaacttacgttacgtaacctaaacgttacgttaccggtaacccgggttgggtcccgggtcccgggttacccgggggaccctttaccgggtttccgggaccccgttaaggggtaaaccctaaaagggtttgaacggtacttaaaccgaaacggtaaccgtggttacgctacgacccacgtaacgttctacgttaccttactccgttcccgttacccgaacg

SEQ ID NO: 341924 - DNA, 714 bp, Homo sapiens
  misc_feature: GZ8MTXP02GXOOM.9.33.C11.1.454.CMB.2.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagagtcgttacccaccagttacgcctaggtaacccaacaccaaacctggcccaggcctcccaggccccctnatctttgatgcatccatcgaggccacgtggccatccccagccctaggttccaggtcggctaggttggggtctagggacagtaccttcacgtctacaccatccagcacgcctagacgtcctagtaacgtattttgaccttagtttaactacttacgtactaaacgtacgttaccggtacgtaggtccggtcccgggttaccccgggggccctttaccgggtttacccggggtacccccggttaacgggggtaaacccgttaaaaacgtttcggtaaaacggtaaccgttaaaccggtaaaaaccggttaacccggttaaacgggtccggtaccgtttaccggacccgttaaacccgttaatcccgttaacggtttcccttaccgttaaccgtttcccccgttaacccggttaccg

SEQ ID NO: 341925 - DNA, 663 bp, Homo sapiens
  misc_feature: GZ8MTXP02J2J3X.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggggctgggtccagccgtggggacggtccctgagactctcctgtgcaggctctggattcaccttcaagtaactacggcgtgcacgtgggtcccgccaggcctccgaggcaagggcttaggagtggctggctagttgttcatcgtagaaggtagtgtacaatactatacagtacctaccggtagaacgggtccgtattacccacctactacctaccgaagaacgtaactaacttacccaaacgaaacaaccgtatagttaactactcggaactaaagtaggaaccgaagtaaccgtaaggtaaggttacggaacggtaccgtacggtacgtttagttttaacgttaacgttacgggtaaacgggtaaaacgggtaggggggtaaactaacggaaggttacggaaccgacggtaccgtaccgtaaacggttaccgttaacgtttacgttaaccgg

SEQ ID NO: 341926 - DNA, 591 bp, Homo sapiens
  misc_feature: GZ8MTXP02G4QWV.9.33.C11.1.454.CMB.2.raw
  modified_base (299)..(299): a, c, t, g, unknown or other
  misc_feature (299)..(299): n is a, c, g, or t
  modified_base (514)..(514): a, c, t, g, unknown or other
  misc_feature (514)..(514): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctgggtccagcctgggaggtccctgagactctcctgtgcaggctctggattcaccttcagtaactacggcgtgcacgtgggtcccnccaggcctccgaggcaaggggcttggagtggctgggctagttgttcatctagaaggtaattgttacaaattactaataccgagacctccggtaggaaacggggtccctattacccaaccctattaccgtaccaagaacgaactaaacttaccaaacgaaacacgatagtaatctagactaaagtcgaacagacctaagagttagacgacgacgtntacgtttaatacgtaggtaacggtaaaggagggggtatacgagtggaacagactacgaagtactacgttacgtaccg

SEQ ID NO: 341927 - DNA, 575 bp, Homo sapiens
  misc_feature: GZ8MTXP02FN88O.9.33.C11.1.454.CMB.2.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (525)..(525): a, c, t, g, unknown or other
  misc_feature (525)..(525): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangccaccctctcctgcagggccagtcagtacgtttaccaccagttagcctgtaccaacacaacgtggcaggctcccagcccctcatcttgangtcatcatnacgggccactgcactccacgcaggttcagtggacnggttcgggtctggggactagtacttcaactctccacaatcagcagcctagagtccagaagtatttgacagtttatacttgactactatcgtacgagtggtcccggtccggggctacccgttcgggacccgtgggtaaaccaagttagacgtactaacaaaccggaatccggtggacctacggaccncgtaactcggtttacgtcctttccacgttaccccttccccggacttaacg

SEQ ID NO: 341928 - DNA, 555 bp, Homo sapiens
  misc_feature: GZ8MTXP02F4SA7.9.33.C11.1.454.CMB.2.raw
  modified_base (245)..(245): a, c, t, g, unknown or other
  misc_feature (245)..(245): n is a, c, g, or t
  modified_base (443)..(443): a, c, t, g, unknown or other
  misc_feature (443)..(443): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccattcaccatctccaganacaattccaagaacacgatgtatctgcaaatggacagacctaagagttgaggacacggcttgtttattactgtaacgaaagagggggatacgagtggcagccctaccaagtactactttgacttcgtcggggccagggaaccctggtccacgtctctcacgcctccacaacgggcccacgtcggtcctccccgtgccnccctgcctccgaggacgccaccgtccgagacgcacgagccggcctggggctcgccgtggtacgaacggcttaccgtccaagacgtaatcgacgtcggacggcggctcggacg

SEQ ID NO: 341929 - DNA, 643 bp, Homo sapiens
  misc_feature: GZ8MTXP02F2HUR.9.33.C11.1.454.CMB.2.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (381)..(381): a, c, t, g, unknown or other
  misc_feature (381)..(381): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgaaggggaaanacgccaccctctcctgcagggccagtcagagtcgttaccaccctagttacgcctggtaaccaacacaaactggccaggcctcccacggcccctnacttctttgatgcactccatcgacgggcccacgtcggccactccccagcccgtaggttccaggtcggctaggtcggggttccnggggacacggtacctttcgacctctcacctatcaagcaacgccgtagacgccgtaggaagttacttttacgctttaagtttaacttacgtacgtacaaactacgtacggtaaccgtggtccgggcccgggttccgggggacccttaccggtttccgggacccggttaacgggaacctaaaacgttggaactaacgtaacgtaaaacgtacgtcggtacgcgtacgaccacgtaacgtctcgtcttctacgttcctaccgtac

SEQ ID NO: 341930 - DNA, 804 bp, Homo sapiens
  misc_feature: GZ8MTXP02GKMRO.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaaggccattcacatctccagagacaattccaagaacacgatgtatctagacaaatggacagacctaagagttgaggacacggtctagtttatacgtagtaacggaaaagggagggggatacgaggtggacaggaccctaccgaaagttacttaattttgaacgtttcgtcgggggccaacgggggtaaacccgttcgggtacctaacccggtcttacccgtaccgtaacgccccttacccgaaacccgaaccggggcccccgtaaaccgttccccgggtttacccgtttccccccccgttcggggccccgccccccgtttcggacccccgttaccccggaaaccggggtaccgacccccgtaaccccggttacccggaaaccggaacggacccgtaaccggaaccccgggcccggggtacccccggttcgggggacccgtaccggggtcccccggttacggggtttaaacccgaaacggggttaaccccttaacccgtttacccgaaccggttaaaccggttaacgttaacccgtaaacggttcgggtaaccggggcccggggtaacggtcggggaaacccgg

SEQ ID NO: 341931 - DNA, 600 bp, Homo sapiens
  misc_feature: GZ8MTXP02JFSZN.9.33.C11.1.454.CMB.2.raw
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggacggtccctgagactctcctgtgcaggctctggattcaccttcagttaactacggcgtgcacgtcgggtccgccaggctccgaggcaagggcttggagtggctggctaggttgtttcattcnggaaggtagtgtacaatacttancagactccggtagaacgggccgtaattcccgacctatcctaccgaagacgaactaacttaccaaagaacacgatacgtatctagactaaagtcgaacagaccgtaagagttaggacgacgtacgtcgttagtttaacgttacgtaggtaaacggtaaaggggagggggtactaacggtaggtacggaacgtacgaccgtacgtaacgtacgtttacgttagtaccg

SEQ ID NO: 341932 - DNA, 685 bp, Homo sapiens
  misc_feature: GZ8MTXP02ITH6F.9.33.C11.1.454.CMB.2.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcagggccagtcagagtgttaccacctagttacgcctaggtaaccaacacaaacctggaccaggcctcccaggcccctnatcttgatgcatccatcgaggccagtggcactcccagcctaggttcagtcggctagggtgggtctggggactaggtaccttcacttctacacctagtccagcacgcctagacgcctagaagttntttcgacttaagttttactacgtagtacctaaacgtacgttaccgtaaccggtaggttcccgggtccccggttaccccgggggaccttaacccggttttcccgggacccccggttaaacggggtaaaaccccttaaaaggtttcgaaacggttaactaaacccggtaaaaacggtacttacggggtaacgtccgttacggaaccctaacccgtaagtttccttacgttacccttacctacctttccccgtttaccccgtaaccg

SEQ ID NO: 341933 - DNA, 622 bp, Homo sapiens
  misc_feature: GZ8MTXP02FX6QV.9.33.C11.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (417)..(417): a, c, t, g, unknown or other
  misc_feature (417)..(417): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaancgccaccctctcctgcagggccagtcagagtgttaccacctagttacgcctggtaaccaacacaaaccgtggccaggcctccacgcccctnatcttgatgcatccatcgaggccagtggccactccccagccgtaggttcagtggactaggtgggtactggggacagtaccttcactcaccacatcaacgcagacctagcaccgtagaaacttnttttgacttaagttttactagtactacaaaacgtgtaccgtacggagtccggtccggtcccggggtacctaccgtttccggaccggttacggaacctaaaagttcggaactaactaccgaaaacgtacggttggtacggtacctacgccctaaaacccgtaagttccgttacgttaccttacctaccgtttcccgttacccgtac

SEQ ID NO: 341934 - DNA, 598 bp, Homo sapiens
  misc_feature: GZ8MTXP02I7BAW.9.33.C11.1.454.CMB.2.raw
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccacctgttctttgtctccgaaggggaaanacgcccaccctctcctgcagggccagtcagagtcgttacccacctagttacgcctggtaaccaacacaaactggccaggcctccacggcccctnattctttgatgcatccatcaggccatggccatcccagcctaggttcagtggcaggtcgggtctgggacagtaccttcacgtcctacaccagtcagcctagacctagacgcctagaattatttagcttagttttattacgtatacaaatacttacggtacgtaggtaccggccggttacccgggggcccttaacgtttccggcccgtacgggaaccctaaagttcgaacgtaactacgaaaacgtacgtggtacggctacgacacctaatcgtcgttctaccgtacttcccgttaccac

SEQ ID NO: 341935 - DNA, 593 bp, Homo sapiens
  misc_feature: GZ8MTXP02JPF3B.9.33.C11.1.454.CMB.2.raw
  modified_base (278)..(278): a, c, t, g, unknown or other
  misc_feature (278)..(278): n is a, c, g, or t
  modified_base (384)..(384): a, c, t, g, unknown or other
  misc_feature (384)..(384): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggctggtccagccgtggggaggtccctgagactctcctgtgcaggctctggattcaccttnagtaactacggcgtgcacgtcgggtccgccaggctccaggcaaggggcttggagtggctgggctagtttgttcatcgtaggaacggtagttgtacaaatctatacngtactcggtaggaacggggtccattcacctatcctaccgagacactaacttaccaaagaacacgtatagtactcgtgaacaaagtggacacgtacctaaaggagttaggaaggtcaacggtcttagttaacttacggtagtaacggaaagggtaggggaactacgacggtgacgaacgtctaacgaacgtcttacgttcgactttcggg

SEQ ID NO: 341936 - DNA, 569 bp, Homo sapiens
  misc_feature: GZ8MTXP02ILIQG.9.33.C11.1.454.CMB.2.raw
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcgtggggggggcgtggtccagccgtgggaggtccctgagactctcctgtgcaggctcgtggacttcaccttcagtaactacggctgcacgtgggtccncaggctccaggcaaggctggagtggctgggctagtttgttcatcgtgaaggtagtgttacaatactanacagactcgaggacggccattcaccatcacagagacaattaccaagaacacgatagtatactagacaaagtagaacacgaccgtaaagagttaggacggacgacggtacgtagtttattacgtaggtaacgaaagggtagggggaactacgagtcggacaagacgtactaacgtacttacttacgtacgtttacgg

SEQ ID NO: 341937 - DNA, 726 bp, Homo sapiens
  misc_feature: GZ8MTXP02JNTFJ.9.33.C11.1.454.CMB.2.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (305)..(305): a, c, t, g, unknown or other
  misc_feature (305)..(305): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtcttgtctcgaggggaaangccacctctccngcagggccagtcagagtcgttacccacctagttacgcctaggtaacccaactaccaaaccgtggacccaggcctaccccgaggcccccctntacttcttagactcgacctactacccagtaccggacgggacctacggtcggacctacctaccccgacgtacccgtacggttaccgagggtcggacggtacggggttcgggtaccggtacggggaacctacggttaccttaccaccttcctaccaaccgtactaccgacgtaccacgtaccgtacgacgtaccgtaagtaacgttacgtttacgtacgtttaagttttaacgttacgtacgttaacgtaaactacgttacggtaccggtacggtaccgggtacccgggtacccggggtacccttaccggttcccggaccgtacgggtaaccttaagtacgaacgtaacgtaacgtaaacgtacgtggtacgtcgtacgactacgtaacgttcgttacgtctactaccgttcccttaccgtac

SEQ ID NO: 341938 - DNA, 621 bp, Homo sapiens
  misc_feature: GZ8MTXP02GB3JW.9.33.C11.1.454.CMB.2.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
tcagtgatacgtctcacgaccggtgctcgatttagagtgagctcgttgggtttgggggaggaactgctcagttaggacccagagggaaccatggaagccccagctcatcttctcttcctcctgctactctggctcccagataccaccggagagattgtgttgacacagtctccagccacctgtctttgctccaggggaaangccaccctntccngcaggccagtcagagtgtaccaccagttancctggtaccaanacaaactggccaggctccaggccctnatcttgatgcatcatcaggccatgcatcccaaagngttnagtgactagtggtctgggacagtacttcgactctacactatccgagtcagtccctagacgcctagaagtatttgactagtttatactgtactaactagtaccgtacgtagtcggtccgtaccgggggtcctaaccgtttccgggaccccgttacggggaaacctaaaacgtttcggaaacgtaaccgtaaaccgtaaaacggtaaaccgttacggtacgggtaccgttacgacccgtaacccgtaacttccgttacggtttaccttaccgtaacttccgttacccccggtactttaaccg

SEQ ID NO: 341939 - DNA, 570 bp, Homo sapiens
  misc_feature: GZ8MTXP02HXRPI.9.33.C11.1.454.CMB.2.raw
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtcccnccaggcctcccgagggcaaggggcttggagtggctggctagtttgttcatcgtgaaggagtgtcaaatctatacngtactcgtgaagggccattcaccatcncaganacaattaccaaanacacgatgtatctagacaagtgacagactaagngtagaggacacgntagttacttacgtagtaacggtaaagggagggggtaatacgtaaggtcggtacaacgtaccgtaaccgtaacgttaaccgtactttacggtaacgtttccggg

SEQ ID NO: 341940 - DNA, 545 bp, Homo sapiens
  misc_feature: GZ8MTXP02FTEBE.9.33.C11.1.454.CMB.2.raw
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
  modified_base (425)..(425): a, c, t, g, unknown or other
  misc_feature (425)..(425): n is a, c, g, or t
tcagtgatacgtctcacgaccggtgctcgatttagagtgagctcgttggggttgggggggagaggagcccagcactagaagtcggcggtgtttccattcggtgatcagcactgaacacagaggactcaccatggagtttgggctgagctgggttttcctcgttgctcttttaagaggtgtccagtgtcaaagtgcaactggtggatcgtggggggggctggtccagcctggggaggtccctgagactctcctgngcaggctctggattcaccttcagtaactacggcgtgcactgggtccgcaggctccaggcaaggggcttggagtggctgggcagttgtttcatctgaaggagtgtcaatactatacngactccgtgaagggccattcacatctccagagacaattaccaaagaaacaacgangtatctgacaaaatggacaggacctaaagagttagaggacacggctgttatactagtacgaaaaggagggggatacgagtggacgaagctaccaaacgtacttactttacgactttacgg

SEQ ID NO: 341941 - DNA, 575 bp, Homo sapiens
  misc_feature: GZ8MTXP02F3RAG.9.33.C11.1.454.CMB.2.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (533)..(533): a, c, t, g, unknown or other
  misc_feature (533)..(533): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcacccttnagtaacacggctgcacgtggtcccnccgaggctccaggcaaaggggcttggagtggctggctagttgtttcatcaggaaaggtagtcgttacaaatactaatacgagaacgtccggtgaaacggtccgtattcccaacatctaccaagacgaactaactacaaagaacaacgatagtaatacagtaacaaatacggacacgactaaagtagtacggaagaccgaggtctagtttatacgtagtaaggaaaggaggggactagtagngtacagactaacgacgtaactacgttgtactcgtacggaccg

SEQ ID NO: 341942 - DNA, 607 bp, Homo sapiens
  misc_feature: GZ8MTXP02IR6AB.9.33.C11.1.454.CMB.2.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccaggggaaangccaccctntccngcagggccagtcagagtcgttaccaccagttacgcctggtaaccaacacaaacctggccaggcctcccacggcccctnattcttgatgcatccatcgacgggccacgtggcactcccagcctaggtcagtggcaggtgggtctggggacagtacttcactctacaccatcagcacgcctagacgcctagtaagttagtttagacttaagtttacttactacgtacaaactattaccggtacgtaggtcggcccggtcccggggtcctaccgtttccgggacccgtacggggaaacctaaaagttcgaacgtaactaaccgtaaaacgtacgttaggtcggactacgacctaaccgtaagttctcgttcttactaccttccgtttacccgtac

SEQ ID NO: 341943 - DNA, 639 bp, Homo sapiens
  misc_feature: GZ8MTXP02FZTDQ.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggggcgtggtccagccgtgggaggtccctgagactctcctgtgcaggctcgtggattcaccttcagtaactacggcgtgcacgtgggtccgccaggctccaggcaagggcttggagtggctgggctagtttgttcatcgtaggaaggtaagtgttacaaattactaataacagtacctccggtaggaacggggcctaagtttaccaacctactacctaccagaacgaactaaacttaccaaagaaacaacgatacgtatacgttagaacaaaagtggaacacggtacctaaagtaggttagaacggaacgacggtcttaagtttacttaacgtaggtaaacggtaaaaggggacgggggtaaatacggaaggttcggacgaacgtacctaacgtaaacgttacgttaacgtttacgtacgtttaccgggg

SEQ ID NO: 341944 - DNA, 646 bp, Homo sapiens
  misc_feature: GZ8MTXP02FNM2T.9.33.C11.1.454.CMB.2.raw
  modified_base (204)..(204): a, c, t, g, unknown or other
  misc_feature (204)..(204): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanacgccaccctctcctgcacgggccagtcagagtcgttaccaccagttacgcctaggtaccaacacaaacctggccaggcctcccacggccccctcactctttgatcgcactccatcgacggccactcggcactaccccgagccgtaggttcaggtcggctaggtgggtcgtaggggactaggtaccttcnctcncaccatcagcacgtcctagacgtcctagaacgttntttagacttaagttttacttacgttacgtactaaacgtagttaccggtaccggtagggttccgggtccccgggtccgggggtaccccttacggtttccccgggacccggtttaacggggaaacctaaaagttggaaacgtaacgtaaccgaaaacgtaagtggtacgctacggacacctaagttctcgttaccttactaccttcctccgtacc

SEQ ID NO: 341945 - DNA, 606 bp, Homo sapiens
  misc_feature: GZ8MTXP02GWJJJ.9.33.C11.1.454.CMB.2.raw
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagcttgggttttcctcgttgctcttttaagaggtgtccagtgtcaagtgcaactggtggagtcgtggggggggctggtccagcctgggaggtccctgagactctctgtgcaggctctggattcaccttcagtaacctacggcgtgcacgtcgggtccgccgaggcctccgaggcaaggggtcttgggagtggcgtggctaggttgtttcatcgtagaaggtagtcgttacaatactatacagtactccgtagaacgggccattccacntcctcagacactaactaccaaagaacacgatgtactntgacaaagtagacagaccgtaaagagttagaagacgtacggtcttagtttaagtacgtaaggtaaacgaaaaggggagggggtaactaacggtaggtacggaccgtagtaccgtaacgtaaacggttacttacgtttacgtacgtttaccgggtacgggacccgg

SEQ ID NO: 341946 - DNA, 557 bp, Homo sapiens
  misc_feature: GZ8MTXP02JDMZV.9.33.C11.1.454.CMB.2.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (544)..(544): a, c, t, g, unknown or other
  misc_feature (544)..(544): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcagggccagtcagagtcgtaccaccagttacgcctggtacccaanacaaactggccaggcctcccaggcccctnactcttgatgcatccatcgaggccacgtggcactcccagccaggtcagtggcaggtgggtctaggggacagacttcgctctacaccatccagcacgaccctagacgcctagaacgttattttgacttagttttattactgttacaaactagtacgtacgtagtcggccggttccgggggcctacgtttcggcccgtggaaccaaagtgaagtactacgaaacgactgtcggctagccacaatctgtccttnactccttcccgac

SEQ ID NO: 341947 - DNA, 555 bp, Homo sapiens
  misc_feature: GZ8MTXP02JQ0AX.9.33.C11.1.454.CMB.2.raw
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaaggccgattcaccatctccagagacaattccaagaacacgatgtatctgcaaatggacagcctaagagttgagacacggctgttatactgtacgaaagagggggatacgagtggcagcctccaagtactactttgacttctgggggccaggggaaccctggtcaccgtctcctcacgcctcccaccgaacggccccagtccggtccttcccccgtggccgccctgcctccaggcgcacccgtccgagacgcacgacgccggcccgtgggctcggcctggtccgaaaggacctaccgttccagacgtaacgtccactggacgcgggctcggacg

SEQ ID NO: 341948 - DNA, 594 bp, Homo sapiens
  misc_feature: GZ8MTXP02GCN7C.9.33.C11.1.454.CMB.2.raw
  modified_base (309)..(309): a, c, t, g, unknown or other
  misc_feature (309)..(309): n is a, c, g, or t
  modified_base (380)..(380): a, c, t, g, unknown or other
  misc_feature (380)..(380): n is a, c, g, or t
  modified_base (458)..(458): a, c, t, g, unknown or other
  misc_feature (458)..(458): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtggggacgtccctgagactctcctgtgcaggctcgtggtacttccaccttcagtaacctacgggcgtgcacgtcggggtcccnccgaggcctccgaggcaaggggtcttgggagtcggctgggctaggtttcgttcagttcgtaggaagtagtntacaatactatacagtactcgtagaacggcgtatcaccatcctacagagactaataccaaagaaccagatgtatcganacaaagtcgaactacgacctaaaggtgtaggaacgacgtacggtactttagtttactacgtaaggtaacgaaaggggtaggggtactaagaggtacgaacgtacgactaccgtaagtacgttacgttacgtaccgg

SEQ ID NO: 341949 - DNA, 626 bp, Homo sapiens
  misc_feature: GZ8MTXP02GYFZQ.9.33.C11.1.454.CMB.2.raw
  modified_base (300)..(300): a, c, t, g, unknown or other
  misc_feature (300)..(300): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcggtgggggggggctggtccagcctgggaggtccctgagctctcctgtgcaggctctggattcaccttcagtaactacggcgtgcacgtgggtccnccgaggcctccgagggcgaaggggtcttggaggtggcgtggctagtttgtttcattcgaggaaggtagtgttacaagtactatacagtactccggtagaacgggtcctattccgaacctatcctacaagacgaacaaacgttaccaaagaaacacgtatgtaactctagactaaaagtacgacgaacgaccgtaagtaacggttgacggtaacgtacggtacttagtttacgttacgtaggtaaacggtaaaagggtagggggtaacgtacgagtcgggtaacgaacgtaccgtacgtaaacgttacttacgtttacgttaaccgg

SEQ ID NO: 341950 - DNA, 732 bp, Homo sapiens
  misc_feature: GZ8MTXP02IIHCG.9.33.C11.1.454.CMB.2.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgttcttttgtctccgaaggggaaanacgccaccctctcctgcagggccagtcagagtcgttacccaccagttacgcctaggtacccaaacaccaaacctggccacggctcccacggcccctnattctttgatcgcatccatcgacgggccacgtggaccactccccgagccgtaggttcaggtggcgtaggtcggggtcgtagggactaggtaccttcncctctaccacctatccgagcacgaccgtagacgtccgtaggtaaagttattttagacctttaagttttaacttactcgtaactaaacgtacgttaaccggtaaccggtaccggttccggggtaccccgggttccccggggggtacccttacccgggtttacccggggtaccccggttaacgggggtaaaacccttaaaaacggtttcgggaaacgttaaacgtaaaccgtaaaaccggtaaccgttacgggtacgggtaccttaccgacccgtaaacctaacgtttccgttacgtttccttacgtaccctttccccgttaccccgtaaccc

SEQ ID NO: 341951 - DNA, 584 bp, Homo sapiens
  misc_feature: GZ8MTXP02FMXT2.9.33.C11.1.454.CMB.2.raw
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggaggtcggtgggggggggcgtggtccaggcctggggacggtccctgagactctcctgtgcaggctctggattccaccttcagtaactacggcgtgcacgtgggcccgccaggcctccgaggcgaagggtcttggagtggctggctagtttgttcatcgtagaacggtagttgtacaatactatacngactcgtagaacggcctatcacatctcanagacaatacaanaacacgatagtatctagacaaagtgaacacgacctaaagagttaggaggaacacggtacttagttaacttacgtaggtaaacgggaaagggtaagggggaactacgagtggacgaagacctaacgaacgttacttacgttacgtacgttacgg

SEQ ID NO: 341952 - DNA, 660 bp, Homo sapiens
  misc_feature: GZ8MTXP02GF367.9.33.C11.1.454.CMB.2.raw
  modified_base (312)..(312): a, c, t, g, unknown or other
  misc_feature (312)..(312): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctgggtccagccgtggggacggtccctggacgtactcctcctggtgcaggctgtggacttcaccttcagtaacgtacggcgtgcacgtgggtcccnccgaggcctccgaggcaagggcttggagtggctggctagttgttcatcgtagaaaggagtgttacaattactatacagacttccgaggaacggtccgtattaccaccatccgtacaagacgaacaattacccgaaagaaacacgtatagttactacgtacgactaaagacggaacgaacgtaaccgtaaaggtacgttaggaacggacgtaacgggtacttacggttttaacgtacgtttaacggaaaacgggtaaaaggggtagggggtaaacgttaacggaggttacgggaacctacggtaccgttaaccgtaaacgttaacgtttacgtttacggtttaacccgg

SEQ ID NO: 341953 - DNA, 699 bp, Homo sapiens
  misc_feature: GZ8MTXP02JO3WV.9.33.C11.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagctctcctgtgcaggctctggattcaccttnagtaactcggcgtgcacgtgggtccnccaggcctcgaggcaagggcttggagtggctggctagttgttcatcagaagagtgtacaatactatacagactaccgtagaaacggggtccctaaatttcccaacctacttaccctaccaagggtaacgaacctaaacgttacccaaaacggaaacctaaccggtaacttagttaaacttaccgttaaggaacctaaaagttacgggtaaaccaaacgtacccgttaaaagggtacggtttacgggaagggaaccgtaacggggtaccgttaggtttttaaaacgttaccggttaaggttaaaccgggtaaaaggggaaacggggggtaacttaaccgggaggttacgggtaacgaacggtaccgtacccgtaaaggttaccttaaccgtttagtttaacccgg

SEQ ID NO: 341954 - DNA, 529 bp, Homo sapiens
  misc_feature: GZ8MTXP02HT94Q.9.33.C11.1.454.CMB.2.raw
  modified_base (378)..(378): a, c, t, g, unknown or other
  misc_feature (378)..(378): n is a, c, g, or t
  modified_base (467)..(467): a, c, t, g, unknown or other
  misc_feature (467)..(467): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggtattcaccttcagtaacctacggcgtgcacgtgggtcccgccgaggcctccgaggcaagggcttggagtggctgggctagttgttcatcgtagaagtatgttacaatactatacngactcgagaacggccatcacatctcagagacaattaccaaagaacacgatagtatactgacaaatgacagactaagagtagagacacgntagttatactagtagaagaggggatacgagtgacaagcactacgtactacttacgtactcgg

SEQ ID NO: 341955 - DNA, 565 bp, Homo sapiens
  misc_feature: GZ8MTXP02F7JA0.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctggggttttcctcgttgctcttttaagaggtgtccagtgtcaagtgcaactggtggagtcgtggggggggctggtccagcctgggagtccctgagactctcctgtgcaggctctggattcaccttcagtaactacggctgcacgtgggtcccgccaggctccgaggcaagggcttggagtggctggctagttgttcatctgaaaggtagtgttacaaatactatacagacgtccgtagaacggggcattccacatctcagagacaataccaaagaacacgatgtatactagacaaatggaacaagaccgtaagagttaggaacggacgtacgtcgttagtttaacgttacgtaggtaacggaaagggaagggggtataacgagtaggaacgagacgtacgaagtacgtactttagtaaccg

SEQ ID NO: 341956 - DNA, 701 bp, Homo sapiens
  misc_feature: GZ8MTXP02GOISJ.9.33.C11.1.454.CMB.2.raw
  modified_base (249)..(250): a, c, t, g, unknown or other
  misc_feature (249)..(250): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggacgtccctgagctctctgtgnnggctctggattcacttcagtaactcggcgtgccagtcgggtccnccgaggctccgaggcagggcttggaggtggctggctaggttgttcngtcgtaggaaggtagtcgttacaaagttacctagtacagtaccgttccggtagggaacgggtcccgtaatttcccaacctacgttcccgtaccctaaaggaacgtaaaccctaaacgttacccaaaaaggtaaacccaaggtaacttacggtaaccttagttaacgacctaaaaggtcgaacgtaacgaaccgttaaaggacgtttaggacggtaacccgacgggtacttacggtttttaaataccggttagggttaaaaccgggaaaggggtaacggggggtaataaccggtacgggttggaaccgtaacggttactaacccgtaaagttacccgtttaaaccgtttggttaaccccggg

SEQ ID NO: 341957 - DNA, 605 bp, Homo sapiens
  misc_feature: GZ8MTXP02HEV0Y.9.33.C11.1.454.CMB.2.raw
  modified_base (385)..(385): a, c, t, g, unknown or other
  misc_feature (385)..(385): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgacgactctcctgtgcaggctcgtggattcaccttcagtaactacggcgtgcacgtcgggtcccgccaggctccgagggcaaggggcttaggagtggctgggctagttgttcatcgtagaaggtagtgttacaatactatacngactcggagaacgggcctatccacatctaccagacgacaactacaaagaacacgtatacgtatctagacaagtcgacacgacctaagagttagaggacgacggtacgttagttaacgttacgtacggtaacggaaacgggtaagggggtaactaacggtaggtcggacgtaacgtacgtaccgtaaacgttaccgttacgtttacgtacgtttaccgggg

SEQ ID NO: 341958 - DNA, 703 bp, Homo sapiens
  misc_feature: GZ8MTXP02I0UQA.9.33.C11.1.454.CMB.2.raw
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggctggtccagccgtggggaggtccctgagactctctgtgcaggctcgtggattccaccttcaagtaacctacggcgtagcctacgtcgggtcccgccgaggcctccgaggccgaagggtcttaggagtggcgtggctagtttgttcatcgtagaaggtagtgttacaaattacgtaatacagtaccgtcggtaggaaacgggccgtaattccacctactcctaccaagaacgaactaacttaccgaaacgtaaacaacgtatacgtactacgtagaacaaagtacgaactaacgaaccgtaaaggtagttacggaacggaccgtacggtacgtttacgtttaaacgttaaccggttagggtaaaaccgggtaaaagggggtaaacggggggtaaactaaccgggtaagggttacgggacgaaacgggttacctaaccgtaaacgtttaaccgtttaccgtttacggtaacccgtttaaccggggg

SEQ ID NO: 341959 - DNA, 694 bp, Homo sapiens
  misc_feature: GZ8MTXP02FKWGP.9.33.C11.1.454.CMB.2.raw
  modified_base (307)..(307): a, c, t, g, unknown or other
  misc_feature (307)..(307): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtgggtggaggtcggtggggggggctggtccagccgtgggacggtccctgagactctcctgtgcaggctcgtggattcaccttcagtaactcggcgtgcgacgtcgggtccncgaggcctcgaggcgaaggggtcttggagtcggcgtggcgttagtttgttacagttcgtaggaaaggtagttacgttacaaaattactaatacgaacgtaccgttccgggtaggaacgggtccctaattcccaacccgtatcccgtaccgaaggtaactaaacctaaacttacccgaaaagtaaacgacgtaagtcgttaaactccgtaagaacgtaaacgtggaaaccgtagtaacccgttaaaggtacgttagggaaacggtacgtaacgggttactttagtttaaacgtacgtaaaggtaaacgggaaaagggtagggggtaactaaccggagggtacgaacgtacgtaccgtaacgtaagtttacgtacgtttacgtaaccgg

SEQ ID NO: 341960 - DNA, 641 bp, Homo sapiens
  misc_feature: GZ8MTXP02HVCSS.9.33.C11.1.454.CMB.2.raw
  modified_base (299)..(299): a, c, t, g, unknown or other
  misc_feature (299)..(299): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggagtccctgagactctcctgtgcaggctctggattcaccttcagtaactacggcgtgcacgtgggtccnccaggctccaggcaagggcttggagtggctgggctagtttgttcagtctagaacggtagttgttcaaaattactaattaacagtactccggtaggaaacggggcccgaatttcaaccctatacctaccacgagaacaaacttaccaaacgaaacaacgtatagtaatactgaaactaaagtaggaacacgtaacctaaagtagttaggaacggaacgtacggtacgttagtttaacttaacgtaggttaaacggaaagggtaagggggtaaataaccgtaggtacggacgaacggactaaccgtaaacggttaactttaacgtttacgttaacgtttccggg

SEQ ID NO: 341961 - DNA, 652 bp, Homo sapiens
  misc_feature: GZ8MTXP02JUPPY.9.33.C11.1.454.CMB.2.raw
  modified_base (307)..(307): a, c, t, g, unknown or other
  misc_feature (307)..(307): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggggctggtccaggccgtggggacggtccctgagactctcctgtgcaggctcgtggattcaccttcagtaactacggcgtgccacgtcgggtcccnccgaggcctccgaggcgaaggggtcttgggagtcggcgtggctaggtttgttcagtcgtaggaaggtagtgttacaatacgtatacagtaccgtccggtaggaacggggcctaagttccaaccgtactacctaccgaaggacaacctaaacttacccgaaagaaaccaacggtattagttactacgtacgaactaaagtcggaacgacgtaaccgtaaaggtaggttacggaacggaccgtacggtctttagtttacgttacgtaggtaaacgggaaagggtacgggggtaatacggagtacggcgaacggtacctaacgtaacgttaccttaacgttgtaccgg

SEQ ID NO: 341962 - DNA, 682 bp, Homo sapiens
  misc_feature: GZ8MTXP02HPIYS.9.33.C11.1.454.CMB.2.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgagggaaanacgccacctctctgcagggccagtcagagtcgtaccaccagttagcctaggtaccaacaaccaaacctggaccaggcctcccgacgcccctnactcttgatgcatccatcgacggccacgtcggacacgtcccagaccgtaggttccaggtcggacgtacgggttcggggtcgtacggggaactaggtaccctttcaccttcctaccaacccattaccgacgacctaacggaccgtaagaccgtaccgtaggaaagttattttacgaccttaagttttaacttaacgttcgtaacctaaacgtacgttaccggtaaccgtaggtccgggtcccggtcccgggggtcccttaccggttccgggacccgtacgggaaaccctaaaagtggaaacgaacgtaacgaaaaccgtacgtacggtacggctacggacctacgtaacgttacctcgtttacctactccttacccttccccgtaaccg

SEQ ID NO: 341963 - DNA, 692 bp, Homo sapiens
  misc_feature: GZ8MTXP02IG1OC.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtgggtggaggtcggtgggggggggctggtccaggccgtggggacggtccctgacgacctctcctggtcgcgtaggctcgtggtacttctaccttcaagtaaccgtacggcgtagcctacgtcgggtccccgccaggcctaccggagggacgtaacgggcgttggggacgtgggctagggcctaggtttgttccgattcgtagaaacgggtattcgttacaaattactaattacgacgtacctacggtaggtaaccgggcctacgttccaaccattccaccaagactaactaaacttacaacgaaacacgtaatatactatagaactaaagtacgaactagtaaccgtaaggtaggttaagacggtaacgtagtacgtttaggtttaacttaaggtacgggttaaagggaaacgggtaaacgggggtaaactaacggtacgtacggacgtaacgtactaacgttaacgttacgtttacgttacggtacggtccgg

SEQ ID NO: 341964 - DNA, 629 bp, Homo sapiens
  misc_feature: GZ8MTXP02JE6BG.9.33.C11.1.454.CMB.2.raw
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (351)..(351): a, c, t, g, unknown or other
  misc_feature (351)..(351): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagactctcctgtgcaggctctggattcaccttnagtaactacggctgcacgtgggtccnccgaggctccgaggcaagggcttggagtggctggctagttgttcatcagaagtagtntacaatactatcgagactaccggtagaacggggtcctaacgttccaacctagtacctacccgaaggtaacaacctaaacttacccgaaaaggtaaaccaaccgtaagttacgttaaactacgtacgaaaccgtaaagttacgaacgtacgaaccgtaaagtaggttaggaaacgacgacgtacgttagtttaacgttagtacggtaaacgggaaagggtagggggataacgaggacgaacgacggtactaacgtaagtacgtttacgttacgttaccg

SEQ ID NO: 341965 - DNA, 700 bp, Homo sapiens
  misc_feature: GZ8MTXP02GSEWC.9.33.C11.1.454.CMB.2.raw
  modified_base (201)..(201): a, c, t, g, unknown or other
  misc_feature (201)..(201): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgtctccgagggaanacgcccaccctctcctgcgagggccagtcagtagtcgttacccacctagttacgcctaggtaaccaaacaccaaaccgtcggacccaggccctcccgacggtcccctctattctttagatcgctatccatcgacggccacgtggcctactcccgacgcctacggttcaggtcggcgtacggttggggtcgtaggggactacggtacctttcaccttctaccaacctataccgaacgtacgacgaccgttaaggaaccgtccgtaaggtaaacgtttgttttacgtaccgtttaaggttttaacttaccgtagtacctaaacgttcggttaccgtaacgggtcggtcccgggtcccgggtacccggggacctttaccggttccggccgtaacgggtaaaccttaagttcgaacgtaacgtaacgtaaacgtaccgtggtacgcgtacgcccgtaaatcttacgttacgttcccttaccgtactttccccgtaccgttccg

SEQ ID NO: 341966 - DNA, 656 bp, Homo sapiens
  misc_feature: GZ8MTXP02FX553.9.33.C11.1.454.CMB.2.raw
  modified_base (301)..(301): a, c, t, g, unknown or other
  misc_feature (301)..(301): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagccgtgggaggtccctgagactctcctgtgcaggctctggattcaccttcagtaactacggcgtgcacgtgggccncaggctccaggcagggcttggagtcggctgggcagtttgttacagtctaggaaggtattgtactaatactaatacagacctcggtaggaaacgggccgtattccactactctaccaagagaacaattaccaaacgtaacgaacgtatacgtataccgtagaacaaacgtacgaacgtaacggacccgttaaaaggtacggtttagggaacgggtaaccgtacggtaacgtttacggttttaacgttaacgttagggtaaaaccggtaaaggggtaaaggggggaaacttaacggacgggttagacgaaggtaccgtacgtaaacgtacgtttacgtttacgtacgtttaccgggg

SEQ ID NO: 341967 - DNA, 630 bp, Homo sapiens
  misc_feature: GZ8MTXP02JGD7Y.9.33.C11.1.454.CMB.2.raw
  modified_base (243)..(243): a, c, t, g, unknown or other
  misc_feature (243)..(243): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatcgtgaaggaagtgttcaatactatacagactcgtgaagggccattcacatctcaganacaattccaagaacacgatgtatctgcaaatggacagacctaagagttgagacacggctagtttatatagtaacgaaaggagggggatacgagtgcagccctaccaagtactactttgacttcgtcggggccaacggggtaaccctgggtaccacccggtcctacctcgacgtcccgtacccaccgaaacggggtcccctacgtcccgggttaccccttccccccggtgggccccgtccccgttcgcccgtacccggacggaccgtcccacccgtccgacgacgaccacgacgcccggccgtcgggcctacggtccgtaggtaccgaaggtacccttactccgaacggtacgtaacgtcgaacgtacggacgcgggccgtaggaccg

SEQ ID NO: 341968 - DNA, 780 bp, Homo sapiens
  misc_feature: GZ8MTXP02IUV1K.9.33.C11.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcaccttnagtaactacggcgtgcacgtgggtccnccaggcctccgaggcaaggggcttggagtggctgggctagtttgttcagtcgtaggaacggtatgttaccaaattactaataacgaggtaccttaccggtaggaaacggggcctaatttaccaacctaacttcccgtacccgaagtaacgaaacctaaactttacccgaaaacggaaaccaaccgtaacgttacggttaattacccgttaggaaacccgtaaaaggttacggggaaaccaacgggtaacccgtaaaacgggtaacggtttacgggaaaagggaaccggtaaccgggggttacctttaagggttttaaaccgtttaaaccggttaagggttaaaaccggggtaaaaacgggggaaacgggggggttaaataaacccgggtaacgggttacgggtaacccgaaacggtacccttaaacccgtaaaacggtttaaccttaacccgttttaggtaaacccgttttacccggggg

SEQ ID NO: 341969 - DNA, 825 bp, Homo sapiens
  misc_feature: GZ8MTXP02FQOUZ.9.33.C11.1.454.CMB.2.raw
  modified_base (190)..(190): a, c, t, g, unknown or other
  misc_feature (190)..(190): n is a, c, g, or t
tcagtgatacgtctcacgaccggtgctcgatttagagtgagctcgttgggtctggggagaggagcccagcactagaagtcggcggtgtttccattcggtgatcagcactgaacacagaggactcaccatggagtttgggctgagctgggttttcctcgttgctcttttaagaggtgtccagtgtcaagtncaactggtggaggtcggtggggggggcgtggtccgagccgtggggagtcccgtgagactctcctgtgcaggctcgtggattcaccttcacgtaactacgggctgcacgtcgggtccgccaggcctccgaggcgaagggtctggagtggcgtaggctagtttgttacagtcgtaggtaaaggtaagttcgttaacaaacttaacgtaacttaccgaacgtaccgttacccggggtaaggtaaaccgggggtacccgtaaactttaccctaaaccctacttacccgttacccgaaacggtaaccggtaaaaccctaaaccgttaaccccgaaaaacgtaaaacccgtaaaccgggtaaattacggtttaaacgttaccttaacggtaaaccctaaaaaggttacggaaaacgtaaccggtaacccgttaaaaggtaacggttaagggaaacgggtaacccgtaacgggttaccgtttaacggtttttaaaacgtttaacggttaaaccgggttaaaacgggtaaacgggggtaaaacggggggtaacgttaaaacggggtaaccgggttagggaacgtaacgtaccgtaaaacccgttaaacgttaaaccgtttaccgttttacggtttaaacccgg

SEQ ID NO: 341970 - DNA, 690 bp, Homo sapiens
  misc_feature: GZ8MTXP02GI9TK.9.33.C11.1.454.CMB.2.raw
  modified_base (205)..(205): a, c, t, g, unknown or other
  misc_feature (205)..(205): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaggggaaanacgccaccctctcctgcagggccagtcagagtcgttacccaccctagttacgcctggtaaccaacaacaaacctggccaggcctcccgacggtcccctactacttctttgatgacatccatcgacggccacgtggacactcccgagccgtaggttcaggtggccgtaggtcggggtcgtaggggactacggtaccttacacctctaccactactcacgcacgacctaggacgtcctaaggtaacgttagttttagacctttaagttttacgttacttagtactaaaccttacgtacccggtacgtacggtaccgggtcccgggtacccggggtaccttacccgggtttccgggacccggttaacggggtaaacctaaaaggtcggtaaacgtaacgtaaaccgtaaaacgtaaccgttggtaacgtccgtacgaccgtaaccgtgttacgttcgtttacctacttaccttcccttacccgtaccg

SEQ ID NO: 341971 - DNA, 672 bp, Homo sapiens
  misc_feature: GZ8MTXP02JT3S1.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtggggggggctggtccagccgtggggacggtccctgacgacttctcctggtgcaggctctggacttcaccttcagtaactacggcgtgcacgtcgggtccgccaggcctccgaggcgaagggctggagtggctggctagttcgtttacagtcgtaggaaggtagttgtacctaattactatcgagtactcgtagacgggcctattcccgacctactccctccgaagactaaaccaacgttaccaaacgaacacgtagttcgttacacgttaccgaactaaagttacggaacctacggaaaccgtaaggtaggttagggaaccggtaacgtaccggggttactttaaggttttaaccgttaaacgggttacggtaaaacgggtaaagggggagggggtaaacttaaccggtaggacggtccgtaacgtaccgtaaccgtagttaacccgtttaggttacgttaaccgg

SEQ ID NO: 341972 - DNA, 669 bp, Homo sapiens
  misc_feature: GZ8MTXP02H8L2C.9.33.C11.1.454.CMB.2.raw
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggcgtgggtccgaggccgtggggacggtccctggacgtactctcctggtgcgaggctcgtggattcaccttnagtaactacggcgtgactacgtcgggtcccnccgaggcctccgaggcgaaggggtcgtgggagtggctggctgttgttcagtctggaagtagtgtaacattactaatacagtactccggtagaacgggccaattacccgacctatcctaccgaagacgaactaacgttaccaaagtaacacgtatagtactcgtaagaactaaagtcgaactacgtaccgtaaaagtaggttaacggaacggtaaccgtacgggttacgtttaacggttttaaagtaaacgtttaacggggtaaaacggtaaaaggggtaagggggtaactaacggtaggtacggaacgtacgtaccgtaacgtaacgtaaccgtttaacgttacgtaaccgg

SEQ ID NO: 341973 - DNA, 596 bp, Homo sapiens
  misc_feature: GZ8MTXP02GTZ5F.9.33.C11.1.454.CMB.2.raw
  modified_base (304)..(304): a, c, t, g, unknown or other
  misc_feature (304)..(304): n is a, c, g, or t
  modified_base (559)..(559): a, c, t, g, unknown or other
  misc_feature (559)..(559): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggagtcgtgggggggcgtggtccagcctgggaggtccctgagactctcctgtgcaggctctggattcaccttcaagtaactacggcgtgcacgtgggtcccnccgaggcctccgagggccaaggggtcttggggagtggctggctagtttgtttcatcgtaggaacggtagttgtacaaattactaatacgagacctccggtagaacgggcctattaccacctatcctaccgagacgaacaattaccaaagaacacgatgtatctagacaaagtgacacgactaaagagttacgaaggtacgaggtctttagttaactacgtaggtaaaggaaagggaagggggactacgagtgganaacggtacacgtaacgtacttacttacgactttcggg

SEQ ID NO: 341974 - DNA, 639 bp, Homo sapiens
  misc_feature: GZ8MTXP02HPI21.9.33.C11.1.454.CMB.2.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctccagataccacggagagattgtgttgaacacagtctccagccaccctgtctttgctcgaaggggaaancgccacctctcctgcagggccaagtcagagtcgttaacccaccgagttacgccttaggtaaccaaacaacaaacctggaccaggcctacccgaggcccctanactcttgatgcaatccaatcgacggcctaagtcggacaacgtcccacggtaccgtaggttccaggtcggacgacggtgggtcgtcggacgagtacttctactctcaccacacacacacgactacgacgaccgtagtaagtatttagtacgttaagttttaagttaacgttacgtactaaactactacgtacggtacgtcggtccggccgggtccgtaccgttccggtaccgtacggaaccgtaaacgttaacgaaggtaacgtaactaaacgaaacgtacggtacgtacgtacgtacactaacgtactacgtactacgtactaccttaccgtacg

SEQ ID NO: 341975 - DNA, 828 bp, Homo sapiens
  misc_feature: GZ8MTXP02GZHVM.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcgtgggggggctggtccagcctgggagtccctgagactctcctgtgcaggctgtggattcaccttcagtaactacggcgtgcactcgggtccgccaggctccgaggcgaaggcttggagtggctgggctaggtttgtttcatcgtggaaacggtagtgttacaaattactataccgagtaccgtcggtaggaacgggtcctaatttaccgaaccctaactccttacccaaaggtaacgaaacctaaacgtttacccaaaagtaaaccgaacgtaagttacgtaacttacgtacgaaacgtaaaacgttacgggaaaccgtaaggtaacccgtaaaaggtacggtttaacgggaacgggtaaccgtaaccggggttacgttttaacggttttaaaacgttttaaccggttaaaacgggggtttaaaaccggtaaaaacggggggtaaaagggggggttaaaccgtttaaaaccggggtaaaacggggtttacccgggggaaacccggttaaaccggggtacccggtttaaaaacccccggtttaaaacgggggtttaaaaccccttttaaacccggtttttaacccgggggttaaacccgttttttaaacccccggggggg

SEQ ID NO: 341976 - DNA, 706 bp, Homo sapiens
  misc_feature: GZ8MTXP02JIJRZ.9.33.C11.1.454.CMB.2.raw
  modified_base (265)..(265): a, c, t, g, unknown or other
  misc_feature (265)..(265): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggaggtcggtggggggggggcgtgggtccagccgtggggaggtccctgagactctcctgtgcaggctntggattcaccttcagtaactacggcgtgcacgtcgggtccgccgaggcctccgaggcgaaggggtcttgggagtcggctgggctaggtttgtttcagttcgtaggtaaacggtaagttcgttactaaattaacctaataccgaacgtaccgttaccggtagaaacggggtccctagttccaacctactccctaccgagtaacgaactaacttaacccgaaacgaaacgtaacgtaatagttaactacgtagtaacctaaagtacgggaactaacggtaccgtaaaggtaggttacgaacgggtacgtacgggtacttagttttaacgtacgttaggtaaaacgggtaaagggtaagggggtaactaaacggcgggtaacggaaccgtaacggtaccgtaaccgtaaacggtttaccgtttaaaccgtttcggttaacccgg

SEQ ID NO: 341977 - DNA, 633 bp, Homo sapiens
  misc_feature: GZ8MTXP02J2GMW.9.33.C11.1.454.CMB.2.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (600)..(600): a, c, t, g, unknown or other
  misc_feature (600)..(600): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtctccgagggaaancgccaccctctcctgcagggccagtcagagtcgtaccacctagttacgcctaggtaccaacaacaacctggccaggcctacccacggcccctnattctttgatcgacatccatccgacggccagtcggcactcccgagaccgtaggttcaggtgggaacggtcgggtcgtaggggacacgtacttcactctacactntcagcacgcctagacncgtagtaacgttntttagacgttagtttacgttactacgtactaacgtacgtaccgtaacggtcggtccgggtcccggtcccgggggtaccttaccggttcccgggtacccggtacgggtaaaccctaaagttcgaacgtaactaaccggaaaacgtacgtcggtacgacgtcgacctacgtntcgttactccttactcctcccgtccgtactacg

SEQ ID NO: 341978 - DNA, 586 bp, Homo sapiens
  misc_feature: GZ8MTXP02H36DW.9.33.C11.1.454.CMB.2.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccacctgtctttgctcgaggggaangccacctntcctgcaggccagtcagagtgtaccaccagttacgcctaggtaccaacacaactgccaggctccagcccctnatcttgatgcatccatcaggcccatggccactccccagtcccgaggttccaggtcggcaggtggggtactggggacaggtacctttcaccttctaccacctatccagcagcctagacgctagaacgtattttgacttagtttatacgtagtacaaagtacttcgtaaccgtaggtcggtcccggtacccggggtcctacgtttccggcccgttaacggggaacctaaaagttcgaagtactaacgaaaacgtacgttgacgtcacgtaccactaacgtcttagtccttacgacttacctccccgac

SEQ ID NO: 341979 - DNA, 622 bp, Homo sapiens
  misc_feature: GZ8MTXP02IF93T.9.33.C11.1.454.CMB.2.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (360)..(360): a, c, t, g, unknown or other
  misc_feature (360)..(360): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaangccacctctccngcagggccagtcagatgttaccaccagttagcctggaccaacacaaacctgccaggctcccagcccctnatcttgatgcatccatcaggccatggcactcccagccaggttccaggtggctaggtgggtctggggacagtaccttcncgtctacacctatcaagcacgcctagacgcctagaaatgttttagacttagtttacttacgtacgtacaaacgtacgttccgtaccggtaggtccgggtcccggtacccgggggtcctaaccggtttcccggacccgttacggggaacctaaaagttcggaaacgtactaacgaaaaccgtacgtacggtacggtacctacggaccaaccgtaacgttccttacgtttaccttaccgtaactttccccttaaccccggtacc

SEQ ID NO: 341980 - DNA, 557 bp, Homo sapiens
  misc_feature: GZ8MTXP02H2YMR.9.33.C11.1.454.CMB.2.raw
  modified_base (297)..(297): a, c, t, g, unknown or other
  misc_feature (297)..(297): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagtgatacgtctcacgaccggtgctcgatttagagtgagctcgtgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcggtggggggggcgtggtccagccgtgggaggtccctgagactctcctgtgcaggctctggattcaccttcagtaactacggcgtgccacgtgggtcccnccgaggcctccgagggacgaagggcttagggagtggctggctagtttgtcatcgtaggaagagtgttacaatactatacgagactcgtagaacggccatcacatcacaganacaatacaaagacagtangtatcagactaanagacgagacgaagagtagagacgacgacgtagttattacgtacgtaaggaaaggaagggagacgacgtagacgacgaacgtactaacgtacgtacgtttacgtacgtacgtaccgggg

SEQ ID NO: 341981 - DNA, 601 bp, Homo sapiens
  misc_feature: GZ8MTXP02G3SO1.9.33.C11.1.454.CMB.2.raw
  modified_base (419)..(419): a, c, t, g, unknown or other
  misc_feature (419)..(419): n is a, c, g, or t
  modified_base (499)..(499): a, c, t, g, unknown or other
  misc_feature (499)..(499): n is a, c, g, or t
tcagtgatacgtctcacgaccggtgctcgatttagagtgagctcgttgggtttgggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtggtcccgccgaggcctccagggtccaaaggggtcttggagtggctagggctaggtttgtttcagttcgtaggaaggtagtcgttacaatactatacgatcgtccgtagacggggtccattccactatcctacanagactaactaccaaataacacgtatgtatacgtgaacaagtcggaacacgaccgtaaaggagttaacgaggacgaccgtnttagtttaatacgtaggtaacggaagggaggggtacaacggagtcggacgagtacgtaaccgtaagttacttacgttacgtacgttcggacgggtaacccgg

SEQ ID NO: 341982 - DNA, 637 bp, Homo sapiens
  misc_feature: GZ8MTXP02JG7X4.9.33.C11.1.454.CMB.2.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaangcccaccctctcctgcagggccagtcagagtgttacccaccagttacgcctggtaacccaacaccaaaccgtggccaggcctcccaggcccctnatctttgatgcatccatcgagggccactggccatccccagccctaggttcagtggcaggtggtcgngggacagtaccttcnctctcaccatcagcagcctagacgctagaagttattttgacttaagtttattactagtactaaactagttaccgtaccggtacggtccgggtcccgggtacccgggggtccctaccggtttcccgggacccgttacggggaaacccgtaaaagttgaacgtacgtaaccgaaaaccgtaaacgttcggtacggtcgtacggaccgaccctaagttaccttcggttaccttactaaccgtttccctttccccgaacccg

SEQ ID NO: 341983 - DNA, 706 bp, Homo sapiens
  misc_feature: GZ8MTXP02JZZMQ.9.33.C11.1.454.CMB.2.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (301)..(302): a, c, t, g, unknown or other
  misc_feature (301)..(302): n is a, c, g, or t
  modified_base (674)..(674): a, c, t, g, unknown or other
  misc_feature (674)..(674): n is a, c, g, or t
  modified_base (690)..(690): a, c, t, g, unknown or other
  misc_feature (690)..(690): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctccagataccacggagagattgtgttgacacagtctccagccaccctgtctttgtctccgaaggggaaanacgcccaccctctcctgcagggccagtcaggagttcgttaccacctagttacgcctaggtaaccaacacaaacctggccaggccnccacggcccctnnttctttgatgacatccatcgacggcctacgtggccactcccgacggtccgtacggtttcgaggtcggcgtaggggttcggggtacgtacggggaactacggttaccttcgaccttacctaccctaacctacgtaccgacgtaccgacgtacccgttaacgggaccgtcccgttaagggaaacgtttgttttacggactttaaaggttttacttacgttacgtactaaacgtacgttaccggtaccgggtaggtcccgggtacccgggttcccgggggaccttaccggtttcccggggaccgttacgggaaaccttaaagtcggaactacgtaaacgtaaacgacggtggttacggacctcggaacctacgtnttcgttacttccttanccgtttccctccgtac

SEQ ID NO: 341984 - DNA, 632 bp, Homo sapiens
  misc_feature: GZ8MTXP02FRGJG.9.33.C11.1.454.CMB.2.raw
  modified_base (164)..(164): a, c, t, g, unknown or other
  misc_feature (164)..(164): n is a, c, g, or t
  modified_base (482)..(482): a, c, t, g, unknown or other
  misc_feature (482)..(482): n is a, c, g, or t
tcagtgatacgtctcacgaccggtgctcgatttagagtgagctcgttgggtttgggggctggggagaggagcccagcactagaagtcggcggtgtttccattcggtgatcagcactgaacacagaggactcaccatggagtttgggctgagcgtgggttttccncgttgctcttttaagaggtgtccagtgtcaagtgcaactggtggagtcgtgggggggggctgggtcccagcccgtggggaggtccctgagactctcctgtgcaggctctggattcaccttcagtaactacggcgtgcactgggtccgccaggctccgaggcgaagggcttggagtgggctggcagttgttcatcccgtaggaaaggaagttgttacaaattactatacaagtactaccggtagaaacgggggccaattaccaccatctaccaagaagaacaaattacccgaaaagaaaccacgatagtatactcgaanaaatacggtaacgacgaccgtaaagtaagttaggaaggaacgacgtcgttacgtttaagttaacgtaggtaaacggaaaacgggaaacgggggtaagtaacgtaaggtaacggacgacggacctaccgtaaacggtaactacgtttacgg

SEQ ID NO: 341985 - DNA, 561 bp, Homo sapiens
  misc_feature: GZ8MTXP02GODSF.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggctggtccagcctgggagtccctgagctctctgtgcaggctctggattcacttcagtactacggcgtgcacgtgggtccgccaggctccagggctaggggcttggagtggctggcagtttgtttcatcgtgaaaggacgttgtacaattactattacagaccttccggagaacggccgtaattccacactctaccagagaacaacttaccaagaacacgatagtactactagacaagtggaacagaccaagagttagaggtacgacggtcttagttatacgtagtaaacgaaagggaggggactagacgtgacgaagctacgtacgtactacgttacgacgttcgg

SEQ ID NO: 341986 - DNA, 630 bp, Homo sapiens
  misc_feature: GZ8MTXP02ILO84.9.33.C11.1.454.CMB.2.raw
  modified_base (343)..(343): a, c, t, g, unknown or other
  misc_feature (343)..(343): n is a, c, g, or t
  modified_base (445)..(445): a, c, t, g, unknown or other
  misc_feature (445)..(445): n is a, c, g, or t
  modified_base (524)..(524): a, c, t, g, unknown or other
  misc_feature (524)..(524): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggtttttcctcgtttgctctttttaagaggtgtccagtgtcaagtgcaacgtggtggaggtcggtgggggggggctggtccgagccgtgggacgtccctgagactctcctgtgcaggctcgtggtacttcctaaccttcacgtaaacgtacggcgtcgcacgtcgggtccgccgaggcctccgaggcgaacgggtnttggaggtggctggtctagtttgttcatcgtagaaacggtattgttacaattacctaataccgtagaccgttccggagaaccgggtctattaccaacctacncctaccgaagacgaaacctaacttaacccaaagaactaacgactgtatacctagaactaaatggaactagaccgtaagngtagacgacgtagtcgttagtttactacgttagaaacggtaaagggacgggtaatacgagttgggaatacgtactaccgtaaaagtctttaaacgttcgtaaccgg

SEQ ID NO: 341987 - DNA, 584 bp, Homo sapiens
  misc_feature: GZ8MTXP02IDDKX.9.33.C11.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
tcagtgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggctagttgtttcatctagaaggaagtgttcaatactatacagactcgtgaaggccattccacatcnccagganacaattaccaaagacacgatgtatctgacaaatggacagactaagngttgagacaggctagtttatacgtagtaacgaaagggcggggtaatacgaggtggcgacgcgtaccaagtacttactttgtacttcgtcggggtaccgaacgggtacccttggaccctacgtcgtacctcgacgcctaccacgaaacggccctntccggttccttccccgngggcctccctagccttacgagtcgacctccnccgacgcgacacgacgcgccgtcggcgtcgcgtcgtacgacgacgtacgtactacgacgtaacgtacacgacggacggcggcgtacgacg

SEQ ID NO: 341988 - DNA, 672 bp, Homo sapiens
  misc_feature: GZ8MTXP02GOC7P.9.33.C11.1.454.CMB.2.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
  modified_base (446)..(446): a, c, t, g, unknown or other
  misc_feature (446)..(446): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaanacgccaccctctcctgcgacgggccagtcagagttcgttacccacctagttacgcctaggtaccaacacaaaccgtggccaggcctcccgacgcccctnacttcttgatgcatccatcgacggccacgtcgcactccccagccgtaagggttccaggtggcgtaggttggggtccgtaggggacaggttaccttacncctcctacaccactcgacgacacggctagacgcgtagtaaacgttntttcgacttagtttactacgttacgtaactaacgtacgtaccggtacggtacgggtccggtcccgggtacccggggtaccttaccggttccggacccggttaacggaaacgttaaacgtacgaacgtaacgtaaacgaaacggttacgttacgggtccgtacgttaccaccgtaacctaacgttaccgttcgtttaccttaccgtacctttccccgttaccccgac

SEQ ID NO: 341989 - DNA, 594 bp, Homo sapiens
  misc_feature: GZ8MTXP02GVJ1G.9.33.C11.1.454.CMB.2.raw
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (407)..(407): a, c, t, g, unknown or other
  misc_feature (407)..(407): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagccgtgggagtccctgagactctcctgtgcaggctctggattcaccttcagtaacgtacggcgtgcacgtcgggtcccgccaggcctccgagggcgaagggtcttggagtggctgggctagtttcgttcatcgtagaaggtagtgtacaatactanacngtacncgtagacggccatccacntctcagacgactataccaagaacacgtagtatatactagactaagtcggactacgacctaaaggtagtaggaggaactaggtcttagttactacgtaggtaacggaaagggacgggggtaatacggtagtacggacgaacgtacctaacggtaactacgtttacgtttacggtacgtttacccgggg

SEQ ID NO: 341990 - DNA, 610 bp, Homo sapiens
  misc_feature: GZ8MTXP02JXL7B.9.33.C11.1.454.CMB.2.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
  modified_base (533)..(533): a, c, t, g, unknown or other
  misc_feature (533)..(533): n is a, c, g, or t
  modified_base (609)..(609): a, c, t, g, unknown or other
  misc_feature (609)..(609): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagcccaccctgtctttgtcctccgaggggaaancgccaccctctcctgcagggccagtcagtagtcgttaccacctagttacgcctggtaccaacacaaaccctgccaggcctcccaggcccctnattcttgatgcatccatcgaggccacgtggcactccccgagtccaggttccaggtcggcaggtcggtcgnggggtacaggtacttcacctccactaccatccngaccagtcccgtagtacgccgtagaagttcgtttgaccttaaggtttactactcgtaacaaacgtcttacgacgtgtacgggtccggtccggggacctccggtttcggacccgtggaaccctaaagttgganacctttacgaaaaccggtcttcggcgtcgtaccgacctactaactcgttacttccttacgtaccttccggtccccnc

SEQ ID NO: 341991 - DNA, 742 bp, Homo sapiens
  misc_feature: GZ8MTXP02GP24R.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggaggtcggtggggggggcgtggtccaggccgtgggacgtccctgacgactctccgtgtgcgaggctcgtggtacttcctaccttacgaacgttaaccgtacgggcgtcgccgtaccgtcggggtccccgccgaggtccctccggagggccgtaaaggggtcgttgggaggtcggcgtggcttaggtttgtttcaacgttcgaaggtaaaggtacgttgttaacctaaattacttaagtaccgaacgtaccgttaccgggtaggaaaccggggtcccgtaactttacccaaaccctacttaccctaccgaaaggtacgtaaaaccctaaacgttaccccgaaaagtaaacccgtaacgtaaattacgtaaacttccgtaagaaactaaaagtcggaaaccgtaacgtaacctaaagggtagttagaacggtacgtaccgttagtttacgtttaagtacgtaaggtaaacggaaaaggggagggtaactacgaggtacgaacgtacgtacctacgtaaacgtttaccttacgttacggtaccg

SEQ ID NO: 341992 - DNA, 614 bp, Homo sapiens
  misc_feature: GZ8MTXP02JPZL1.9.33.C11.1.454.CMB.2.raw
  modified_base (166)..(166): a, c, t, g, unknown or other
  misc_feature (166)..(166): n is a, c, g, or t
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
tcagtgatacgtctcacgaccggtgctcgatttagagtgagctcgttgggtttggggggagaggagcccagcactagaagtcggcggtgtttccattcggtgatcagcactgaacacagaggactcaccatggagtttgggctgagctgggttttcctcgttgctnttttaagaggtgtccagtgtcaagtgcaactggtggagtcgtgggggggctggtccagcctggggagtccctgagactctcctgtgcaggctctggattcaccttcagtaactacggcgtgcactgggtccgccaggctaccaggcaaggcttggngtggctgggcagttgttcatcgtagaacggagtgttacaatacgtatacngactccgtgaaaggggcctattccgacacgtctaccagagacaattaccaagaacacgatagtatactgacaaatggacacgacctaagtagttaggaacggacgtaccggaccgtttaggtttaactttaaccggttaggttaaaccggtaaaacgggaacgggggggtaaacttacgtaacggtaggaccgaaggaccgtaccgtaaacgtaacgttaacgtttacggaactttccgggg

SEQ ID NO: 341993 - DNA, 767 bp, Homo sapiens
  misc_feature: GZ8MTXP02I9KDR.9.33.C11.1.454.CMB.2.raw
  modified_base (200)..(200): a, c, t, g, unknown or other
  misc_feature (200)..(200): n is a, c, g, or t
tcagtgatacgtctcacgaccggtgctcgatttagagtgagctcgttgggtttgggggaggaactgctcagttaggacccagagggaaccatggaagccccagctcagcttctcttcctcctgctactctggctcccagataccacggagagattgtgttgacacagtctccagccacctgtctttgtctccgagggaanacgccaccctctcctgcgacgggccagtcaagtgtacgttacccacctaggttacgccgtaggtaacccaaacaccaaacccgtggacccgaggccctacccgacggccccctcaacttcctttagattcgacctactccctagtaccgagggacccacgttcggctaccgtacccgaacgtccgtaacggtttccaaggtcggtaccgtaggggttcgggtccgttaggggaaaccgtacggtacccttacacccgttccgtaaccaacccgtactaccgacgaccgtaacgacccgttaggacccgtaccgtaggtaaaaggtttattttacggtaccttaagtttacttacgtagtaaacctaaacgtaacgttacgtaaccccgggtaggtcccggtacccggggtacccgggggtccccttaaacgggtttccccggaacccgggttaaacgggtaaacccttaaaagttacgggaacttaacgtaccgaaaaggtaccgttagtaccggactacggacttacgaaccgtttcgtcttacctctaccgttccgtacccgtag

SEQ ID NO: 341994 - DNA, 651 bp, Homo sapiens
  misc_feature: GZ8MTXP02G521H.9.33.C11.1.454.CMB.2.raw
  modified_base (366)..(366): a, c, t, g, unknown or other
  misc_feature (366)..(366): n is a, c, g, or t
  modified_base (497)..(497): a, c, t, g, unknown or other
  misc_feature (497)..(497): n is a, c, g, or t
  modified_base (598)..(598): a, c, t, g, unknown or other
  misc_feature (598)..(598): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgtctcttttaagaggtgtccagtgtcaagtgcaactggtggaggtcggtggggggggcgtggtcagccgtgggacggtcctgagctctccgtgtgcaggtctcgtggtactctacccttacacgttaaccgtacggcggtcgcgacgtcgggtccgccgaggcctccggaggcgaagggtcgttaggaggtggcgtggctaggtttnttcgattcgtaggaaggtacgtgttaacgaattacgtaactacgagtaccgtaccggtaggtaacggggcctaacgtcaaccagttccaccagtacgactaacgttaccaaagtaacaacgtatacgttanactagactaaagtcgaacgtaacgaccgttaagaggttacgagacgtagtcgttagtttaacgtacgtaggtaaaacggtagggaacggggtacgtacggnggttacggaagtacgtcgtaacccgtaaggtccttaacggtttcgtaacccgg

SEQ ID NO: 341995 - DNA, 707 bp, Homo sapiens
  misc_feature: GZ8MTXP02F4A20.9.33.C11.1.454.CMB.2.raw
  modified_base (316)..(316): a, c, t, g, unknown or other
  misc_feature (316)..(316): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaagtgcaactggtggaggtcggtgggggggggcgtggtccaggccgtggggacggtccctgagactctcctgtgcaggctcgtggacttcctaccttcagtaacgtacggcgtgcacgtcgggtccnccgaggcctccgaggcgaagggtcgttgggagtgggctgggctaggtttcgtttcagtcgtaggaaggtagtcgtacaatactaatacagtaccgtacggtagaacgggtccgtattaccgacctactcctaccgagaacgaaacctaaacgttacccaaacggaaactaacgtaattacgtaacttacgtaacggaaactaaaacggttacggaaaccgtaacggtaacccgtaaaagggtacggttaacggaacggtaaaccgtaccggttacgtttaacgtttaacgttaaaccgtaggtaaaacggggtaaaagggtaacgggggtatacggtaaggtcggaacgaacgacgtactaaacgtactttaccgtacgtaccgttacggg

SEQ ID NO: 341996 - DNA, 622 bp, Homo sapiens
  misc_feature: GZ8MTXP02IM6CS.9.33.C11.1.454.CMB.2.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
  modified_base (574)..(574): a, c, t, g, unknown or other
  misc_feature (574)..(574): n is a, c, g, or t
tcagtgatacgtctcacgaccggtgctcgatttagagtgagctcgttggggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcaagagttcgttaccaccagttacgcctggtaacccaaacaccaaacctggccaaggcctcccaggcccctnactctttgatgcatcccatcgaggcccaagtggcactcccgagcccagggttcaggtggactaggtgggtcctggggacaggtaccttcactctacacctatccagcagacctagacnctagagtattttgacttaagtttactctagtacaaaactgtacgtaccggtagtccgggcccggttacccggggccttaccggtttcccggaccgtaggggaaaccctaaagtttcggaaagtacgtaacctaaaacgtctagggacgtaccgtntaacccacttaacgtcttacgttccttagacctttccgttaccccgcc

SEQ ID NO: 341997 - DNA, 819 bp, Homo sapiens
  misc_feature: GZ8MTXP02I67XM.9.33.C11.1.454.CMB.2.raw
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcggtgggggggctggtccagcctgggacggtccctgagactctcctgtgcagctcgtggacttcaccttcaagtaacgtacggcgtgccacgtcggtcccgcgaggcctacgaggcaaggggccttgggacgtggcgtggctagtttcgttcagttctagaaaggtagtacgttacctaaagtaaccgttaataccgaacggtaccgttacccggtagggtaaaccgggtcccgtaaatttacccaacccgtacttacccgtacccgaaaggtaaacccgtaaacccgttaaaaccgttaaccccgaaaagtaaaaccccgtacgtaaaacgtttacggttaaaccgttaccgttaaaccggtaaacctaaaacgggttacccgggtaaaccgtaaaaccggttacccgtaaaaggggttacgtttaacggggaaaaccggtaaccggttaacccgggttaccgttttaaacggttttaacgtttaaaaccggttaaggggttaaaaccggggtaaaacggggtaaacggggggttaacgtaaaacggacggggttaacggaaccgtaggtacccgttaacgtaacgttaaccgttacgttttaacgttaacccggg

SEQ ID NO: 341998 - DNA, 660 bp, Homo sapiens
  misc_feature: GZ8MTXP02F6CJ4.9.33.C11.1.454.CMB.2.raw
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
tcagtgatacgtctcacgaccggtgctcgatttagagtgagctcgttgggtttggggaggaactgctcagttaggacccagagggaaccatggaagccccagctcagcttctcttcctcctgctactctggctcccagataccaccgganagattgtgttgacacagtctccagcccacctgttctttgtctccgaggggaaancgccacctntccngcaggccagtcagntgtaccacctgtanctgaccaancaactgcagcnccagccctatcttgatgcatccatcgacggccacgtggcctaactccccgaagccgtaggtttccgagttcgggctacgggttcgggtccgtggggaactacggtacttcgacctttcgacccaccgtattcccaagtcccgtaacgaccgttacggacgttacccgtaaggaaacgttagtttttcggacctttaaaggttttacgttaactacgttactaaaacgtacgttaccggtacgtacgggtccgggtaccgtcccgggggccctacgtttccggacccgttaacggacctaaaagttcgaacgtacgtaaacgaaacggtaacgttacggcggtacctacgccctaacgtaataccgttcgtaccttcgtacttccttcccgaaccc

SEQ ID NO: 341999 - DNA, 613 bp, Homo sapiens
  misc_feature: GZ8MTXP02GCINX.9.33.C11.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
tcagtgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcacttnagtaactacggctgcacgtgggtccncaggctccaggcaagggctggagtggctggctagttgttcatcgtagaaaggtagtgttacaaattacctatacgacgtacgtccgtaggaaacggggtcctaaattcccgaacctatcctaccaagaacgaacaacttaccaaagaaacacgactagtactctagacaaagtggaactagacctaaaggagttaggaacggtacgtacggtacttacgtttacttaccgttaggtaaacggaaagggtacgggggtataacggtaggtaaggcgtaacggtacctaccgtaacgttaccgttactttacggtaaccg

SEQ ID NO: 342000 - DNA, 713 bp, Homo sapiens
  misc_feature: GZ8MTXP02JC3FH.9.33.C11.1.454.CMB.2.raw
  modified_base (289)..(289): a, c, t, g, unknown or other
  misc_feature (289)..(289): n is a, c, g, or t
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgacaacgtggtggaggtcggtggggggggcgtggtccagccgtgggacgtccctgacgtctctcctgtcgcaggctcgtgtacttccgtaccttnaagtaaccgtcggcgtcgactaccgttcgggcccgccgaggcctccgagggtacgaggggtcgttagggacgttcgggacgtcggtccgttaggtttgtttacagttcggtaggtaaaggtacgttacgttaactaaacgttacttaaactacgacggttacccgttcgggtagggaaccggtacccgtatttacccgaaccctacgtccacccgagtaaccgaactaaacttacccgaaacgtaaccgaacgttacgtaatacgttacgtagaacgaacgttagaacgacgtaacgtaaagtaggtagaacggacgtacggtcttagttaagtacgtagggtaaacggagggtaaaggggtacacggtaggtgaccgaagtccgtaacgttaacgtaccttacgtttacgtaacgtttccggg

SEQ ID NO: 342001 - DNA, 750 bp, Homo sapiens
  misc_feature: GZ8MTXP02I97YJ.9.33.C11.1.454.CMB.2.raw
tcagtgatacgtctcacgaccggtgctcgatttagagtgagctcgttgggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtgggtggaggtcggtggggggggctggtccaggccgtgggagtccctgacgactctctgtgcgaggctcgtggtacttccaccttagaacgtactacggcgtgccacgtcgggtcccgccaggcctccgagggacgaaggggtcttggacggtggcgtagggtctaggtttcgttcagtacgtaggtaaaggtagttcgttaacaaacgttactactaacgacggtaccgtcccggtagggaaccgggtcctaactttaccaaccctactacccgtaccgaaggtaaacaacctaaacgttaaccgaaaacgtaacgacgtaattcgtaataccgtagaaactaaaacggttcgaaaccgtaacggtaacccgtaaaggtacggttaacggaacggtaaccgtacggtttacgtttaacgtttaacgttaaacggtaaacgggttaaaacgggaaacgggggtaacgggggtaaacgtaacggtaggtacgacggtaactacccgtaaacgtacggttaacgtttacgtttacggtacgtttaccggggg

SEQ ID NO: 342002 - DNA, 626 bp, Homo sapiens
  misc_feature: GZ8MTXP02HMTHJ.9.33.C11.1.454.CMB.2.raw
  modified_base (318)..(318): a, c, t, g, unknown or other
  misc_feature (318)..(318): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagtgatacgtctcacgaccggtgctcgatttagagtgagctcgttggggtttgggggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtgggggggctggtccagcctgggacgtccctgagactctccgtgtgcgaggtctcgtggtacttccaccctttcaagtaacctacggcgtgctacgtgggtcccncgaggcctccgagggcaaggggcttggagttggcttgggctaggtttcgttcatcgtaggaaggtaattgtacaatactatacngtactcgagagccatcacatctcanacgacaactaccaaagaacacgtatagtatactagaactaaagtgaacagactaagagttacgaggacgacgtcgtagttacgttacgtaggtaaaggtaaaacgggtaagggggtaaactacgggtaaggtaccggacgtaacggtacctaacgtaaaacggttaacctttaaccgtttcggttaaacgtttcccggg

SEQ ID NO: 342003 - DNA, 723 bp, Homo sapiens
  misc_feature: GZ8MTXP02FHQ49.9.33.C11.1.454.CMB.2.raw
  modified_base (366)..(366): a, c, t, g, unknown or other
  misc_feature (366)..(366): n is a, c, g, or t
tcagtgatacgtctcacgaccggtgctcgatttagagtgagctcgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaacgtggtggagtcgtggggggggctggtccagccgtgggagtccctgagactctccgtgtgcagggtctccgtaggacttcaccttcagtaacctacgggcgtcgctacgtgggtcccgccaggcctaccgaggcgaagggcgttggagtcgggctgggtctaggtttnttacatcgtaggaaagtagttgttaacaaattaactacaactaagtaccgtacgtagggtaacggcctaaacttaccacctactacctacgaagtaacgtaactaaactaaccaaacgaaacgaacgtaagtacgtacgtacgtacgtaacgtaaacgttacggaacgtaacgtaaccgtaaacggtacggtaaacggaacggtaaccggtacgttaacgtttaacgtttaaacggtttaaacggttaaacggtaaaacgggtaaaacgggggtaacgggggtaaacgtaacggtacggtaacgggtacgtaacgtaacccgttaaccgttaaaacgttaaccgtttacgtttacgg

SEQ ID NO: 342004 - DNA, 507 bp, Homo sapiens
  misc_feature: GZ8MTXP01DWP02.11.37.D04.1.454.CMB.2.raw
  modified_base (313)..(313): a, c, t, g, unknown or other
  misc_feature (313)..(313): n is a, c, g, or t
  modified_base (496)..(507): a, c, t, g, unknown or other
  misc_feature (496)..(507): n is a, c, g, or t
tcagcgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagatactgaacaattaacgacacggaccaaattattattgtgtacagagacaagtactctaattttgtgttcgtgtcactgctggtccgacccgtgggccagggacctgatcacgtctctcncgcctccaccgaggcccatccggtccttcccctgccaccctcccctccaacgcgcccacccgtcggtcgggggccacgacggcccggtcccgtggggctcggcccgtggtacgaacgggtaccttacgttccgttattctcctcggctggacgcgggcgtcgggacgaacgggcgacaagtgnnnnnnnnnnnn

SEQ ID NO: 342005 - DNA, 504 bp, Homo sapiens
  misc_feature: GZ8MTXP01CXVUD.11.37.D04.1.454.CMB.2.raw
  modified_base (493)..(504): a, c, t, g, unknown or other
  misc_feature (493)..(504): n is a, c, g, or t
tcagcgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggacccctgatcaccgtctcctctcgccctccaccaagggccccatccggtccttcccccctggcctacccctcccctcccaagacgccaccctcgtcgggggcacgacggccgggcccctcggggcctcggccctcggtacgaacgggtaccttacgttccgtactccttctcgcgtgacgcgggctgggcgaaggcgcatgnnnnnnnnnnnn

SEQ ID NO: 342006 - DNA, 520 bp, Homo sapiens
  misc_feature: GZ8MTXP02I48K9.11.37.D04.1.454.CMB.2.raw
  modified_base (384)..(384): a, c, t, g, unknown or other
  misc_feature (384)..(384): n is a, c, g, or t
  modified_base (502)..(502): a, c, t, g, unknown or other
  misc_feature (502)..(502): n is a, c, g, or t
  modified_base (504)..(520): a, c, t, g, unknown or other
  misc_feature (504)..(520): n is a, c, g, or t
tcagcgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgaacaattaacgacacggacaaatattattgtgtcagagacaagactctaattttgtgttcgtggtcactgctggttccgaccccgtgggccagggaaccctgactcaccgtctcctctcgccctccaccgaacgggcccagttccggtccttcccccgtggccctacccctcccctaccaaagcncctacccgtcggtcggggccacgacggccggcccgtggggcctcgcccgtggtaccaacggtactacgttccgtatctcctcgcgtcgacgccgggtctggcgaacggcgacagtagngnnnnnnnnnnnnnnnnn

SEQ ID NO: 342007 - DNA, 471 bp, Homo sapiens
  misc_feature: GZ8MTXP02HVNGF.11.37.D04.1.454.CMB.2.raw
  modified_base (461)..(471): a, c, t, g, unknown or other
  misc_feature (461)..(471): n is a, c, g, or t
tcagcgagagataccacgaccggtgctcgatttagtagcatactgttgggtgcgacaggcccctgggcaaggacttgagtggatgggacagatccacccttacactggcgacacaatttatgcacagaaattttcagggcagatttaccctgaccgaggacacggccatcaccacagtctacatggacctgaagagactgacaattaacgacacggccaaatattattgtgtcagagacaagactctaattttgtgttcgtggtcactgctggttcgaccccgtggggccagggaccctgatcaccgtctcctctgcctccaccaaggcccatccggtctcccctggccaccctccctccaagcgcacctcgtggggccacgacgccggcccgtggggcctgccctggtcaaggtactacttccgtatctctcgctgagcgggctggcgaaggcgcatagnnnnnnnnnnn

SEQ ID NO: 342008 - DNA, 582 bp, Homo sapiens
  misc_feature: GZ8MTXP02JCZ9U.11.37.D04.1.454.CMB.2.raw
  modified_base (246)..(246): a, c, t, g, unknown or other
  misc_feature (246)..(246): n is a, c, g, or t
  modified_base (563)..(582): a, c, t, g, unknown or other
  misc_feature (563)..(582): n is a, c, g, or t
tcagcgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggaccaaatattattgtgtcagagacaagactntaattttgtgttcgtggtcatgctggtccgacccgtggggccacgggaaccctgatccgaccgtctcctctcgccctccaccaacgggccccagtccggtcccttccccccgtggccctaccccgtccccctccgaacgcgccctaccctccggtcggggccaccgacggcccgggccccgtggggcctcgggtcccgtggggtaccgaaacggtacccgtttaaccgtttcccgttaatttccccgtccgttcggccgtttcgggacggggtccgggggtcgttcgggaccgaacggggcccgacgtaagtacggnnnnnnnnnnnnnnnnnnnn

SEQ ID NO: 342009 - DNA, 540 bp, Homo sapiens
  misc_feature: GZ8MTXP01ELZJD.4.12.B01.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgnagtccccaanacagggactgcagtggattggatacatctacttcagtcggaaccccaactacaacccctcctcaggatccagtcgccatatccctggactcgtaccaacaaccccagactctccctgaaccgatgacatcctagtcgaccgctgcgacacagtccgtttatactgtcgcgcgatcgtgggcactcgagtgactagtggtanggacgtcgtggggccaagggccaggtcattcgtcttccgtnacgccttccaaccgaacgggcccaagtccggtccttccccgtgcctaacccc

SEQ ID NO: 342010 - DNA, 558 bp, Homo sapiens
  misc_feature: GZ8MTXP01EAJYJ.4.12.B01.1.454.CMB.2.raw
  modified_base (246)..(246): a, c, t, g, unknown or other
  misc_feature (246)..(246): n is a, c, g, or t
  modified_base (396)..(396): a, c, t, g, unknown or other
  misc_feature (396)..(396): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcagtccccaancagggactgcagtggattggatacatctacttcagtcggaacccccaactaccaaacccctcctcaggactccagtccgccatactccctggactcgtaccaaacaaccccagactcctccctagaaccgatcgaacatctgtcgaccgntcgcgacacagtccgtttatactgtgcgtcgatcgtgggctactcgagtgactagtgtatcggacgtcgtcggggccaagggccacgggtcagttcgtcttccgtcgacgccttccaaccgaacgggccctaagtccggtcccttccccgtgccctaacccc

SEQ ID NO: 342011 - DNA, 559 bp, Homo sapiens
  misc_feature: GZ8MTXP01B7SR6.4.12.B01.1.454.CMB.2.raw
  modified_base (247)..(247): a, c, t, g, unknown or other
  misc_feature (247)..(247): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcagtccccaanacagggactgcagtggattggatacatctacttcagtcggaaccccaactacaacccctccctcaggactccagtcgccatatccctggactcgtccaacaacccccagatctccctgaaccgatgacatctgtcgaccgctgcgacacagtccgtttattactgtgcgngatcgtgggcgactcgagtgactagtggtntggacgttcgtggggacccaaaggggcccacgggtcagttccggtcttcctacacgcccttccaccgaacgggcccctaagtcccgggtcttcccccgtgggccctaacccc

SEQ ID NO: 342012 - DNA, 561 bp, Homo sapiens
  misc_feature: GZ8MTXP01BVQ9E.4.12.B01.1.454.CMB.2.raw
  modified_base (247)..(247): a, c, t, g, unknown or other
  misc_feature (247)..(247): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcagtccccaanacagggactgcagtggattggatacatctactcagtcggaacccccaactaccaacccctcctcaggactccagtccgccatactcccctggacctcgtaccaacaaccccagactcctccctgaacgatgacatctgtcgaccgctcgcgacacagtccgtttattactgtcgcgcgatcgtgggcgactcgagtgactagtggtatggacgtcgtggggacctaagggccacggtcacgttcgtccttccgtcacgcccttccgaccgtaacgggcccaacgtccggtccttccccgtggcccctaaccccg

SEQ ID NO: 342013 - DNA, 607 bp, Homo sapiens
  misc_feature: GZ8MTXP01BQMJJ.4.12.B01.1.454.CMB.2.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (393)..(393): a, c, t, g, unknown or other
  misc_feature (393)..(393): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
  modified_base (527)..(527): a, c, t, g, unknown or other
  misc_feature (527)..(527): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccggnacgtccccaanacagggactgcagtggatggatacatctactcagtacggaaccccaactaccaacccctcctcaaggactccagtcgacctatactccctggacctcgaccaaacaacccagactctccctagaacatgacatctgtcgaccgntcgcgtacacgtagtccgtttataccgtgtcgcgcgattcgagggcctactcggtaagtgaacttagtaggtntcgggacttcgggnggggaaccctaaaggggccctaacgggtctaacgttccggttacccnccgtacgaccgttcccgaccgaaccgaaccgggtcccttaacgttcccggttaccccttccccggtcgcccctaaccccg

SEQ ID NO: 342014 - DNA, 586 bp, Homo sapiens
  misc_feature: GZ8MTXP01D9VNN.4.12.B01.1.454.CMB.2.raw
  modified_base (247)..(247): a, c, t, g, unknown or other
  misc_feature (247)..(247): n is a, c, g, or t
  modified_base (469)..(469): a, c, t, g, unknown or other
  misc_feature (469)..(469): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcacgtccccaanacgagggactgcagtggatggatacatctactcagtacggaaccccaactaccaacccctcctacaggacgtaccagtcgaccactactcccgtgacctcgtaccaacaaccccagactcctccctagaacgatcgactatctgtcgaccgcgtcgaccgacactacgtccgtttaatacgtgtcgcgcgatcgtgggctacgtcgagtgactagtggtagnggtacgtacgtcggggaccaacgggccacggtcacgttccgtccttccctacgacgcccttaccgaaccgtaaccgggcccaacgttcccggtcccttccccgtgcccctaaccccg

SEQ ID NO: 342015 - DNA, 592 bp, Homo sapiens
  misc_feature: GZ8MTXP01CV4NS.4.12.B01.1.454.CMB.2.raw
  modified_base (248)..(248): a, c, t, g, unknown or other
  misc_feature (248)..(248): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcacgtccccaanacagggactgcagtggattggatacatctactcagtcggaaccccaactaccaaaccccctccctcaggacgtccaagtccgccattactcccctggacctcgtaccaaacaaaccccagactctccctgaaaccgatgacatctgtcgaccgctgcgacacagtccgtttaatacngtgcgcgatcgnggacactcgagtgactagtggtagtggacgtcggacggggaaccgaaacgggccacggtcacgttccgtccttccgtacgacgttcccgttaccgaaacccgaaccgggccctaacggttcccggttccccttcccccgtcggcccctaaccccg

SEQ ID NO: 342016 - DNA, 603 bp, Homo sapiens
  misc_feature: GZ8MTXP01AX7QP.4.12.B01.1.454.CMB.2.raw
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
  modified_base (474)..(474): a, c, t, g, unknown or other
  misc_feature (474)..(474): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacgagggactgcagtggattgganacatctactcagtcggaaccccactaccaacccctcctcgacggacgtccagtccgaccatactcccgtggacctcgtaccaacaaccccagactcctcccgtagaacgatcgacactctgtcgaccgtctcggaccgacacgtacgtccgtttatacgtgtacgcgtcgtatcgcggcaacgtcgagtgtactagtggtancggaccgtcggtcggggaccaacgggctacggtcacgttccggtccttccgtacgtcgaccccgttcccgaaccggtaaccgggtccctaacgtcccggttccccttccccgtcgccccgtaacccccg

SEQ ID NO: 342017 - DNA, 573 bp, Homo sapiens
  misc_feature: GZ8MTXP01ELW9H.4.12.B01.1.454.CMB.2.raw
  modified_base (246)..(246): a, c, t, g, unknown or other
  misc_feature (246)..(246): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcagtccccaanacagggactgcagtggattggatacatctactcagtcggaaccccaatacaacccctcctcaggatccagtcgccatactcccgtggacctcgtaccaacaaccccagactctccctgaaaccgatgacatctgtgaccgntgcganacagtccgtttatactgtgcgcgattcgnggacactcgagtcgacttagtaggtagtcgggtacgtcggtacggggaccgaaacgggaccaacggtcacgttccgtccttccgtacacgttcccttaccgaccgaacgggcccctaacgtcccggtcccttccccgtcggccctaacccg

SEQ ID NO: 342018 - DNA, 656 bp, Homo sapiens
  misc_feature: GZ8MTXP01ETG6G.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttcggggtccgcacgtccccaanacgagggactgcagtggattggatacatctacttcagtacggaaacccccaactaccaaaccccctcctacgaggtacgtccagtccgacctacttactccccgtaggtacctcgtacccaaacaaaccccagtactcctccctaggaaaccgatcgactatccgtgtcgaccgctcgacgacacgtacgtccgtttatacgttgcgtcgcgtactccgtggggacccatacggagtcgtaacttaggtggtacgttcgggacgttcggcgggggaccaaagggaccccgtgggtctaacgttcggtcccttaccgtaccgaaccgttcccgttacccgaacccggaaccgggtcccctaacggttcccggtccccttccccgtaacgggttcccctaacccccgg

SEQ ID NO: 342019 - DNA, 630 bp, Homo sapiens
  misc_feature: GZ8MTXP01CUPCB.4.12.B01.1.454.CMB.2.raw
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (564)..(564): a, c, t, g, unknown or other
  misc_feature (564)..(564): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtaccccaanacgagggactgcaggtggattgganacatctactcgagtcggaaccccaactaccaaaccccctcctacgaggacgtaccagtccgacctattactcccgtggacctcgtaccaaacaaccccagactctccctagaaaccgtatcgacagttcgtgtcgacccgctcgacgacacgtacgtccgtttaatacgtgttcgcgtcgacgtcgtgggacacgtcgtaggtcgtaactagttggggtaacgtcgggtacggtcggtacgggggacccgaacgggacccgtacgggtctacgttcgtccttcccgtacncggttcccttaccgaccgtaaccgggcccttaacgtccggtcccttccccgtggcccctaaccccg

SEQ ID NO: 342020 - DNA, 736 bp, Homo sapiens
  misc_feature: GZ8MTXP01DXHV0.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtgcttcagtggattggttactacgtggtaggttcgggtccggctacgtaccccaagacgagggactgcgtaggtggtatggaatacatcttacttcgacggtaccggaaacccccaactacccaaccccctccctacgacggacgtaccacgtccgaccctaattactccccgtaggacctaccgtacccaaaccaacccccagtactcccgtacccgtagaaaccgtatcgaactcgtcctgtacgacccgcgtcggacggacaacgtacgtaccgtttattacgtggtcgccgtacgtacgtcggtcgggaccgtacgtcgggtaacgttcggtaaccgttaggttggtacgtacggggtaccggttaccgggtaccgggggaaccgtaaacggggtcccgtaacgggtaacacggttccggtacccttccgtacccgaccgttacccccgttccgaaaacccgggtaacccggtcccgtaacggttccccggttaccccgttcccccggtaacggttcccccctaacccccg

SEQ ID NO: 342021 - DNA, 565 bp, Homo sapiens
  misc_feature: GZ8MTXP01BFE1S.4.12.B01.1.454.CMB.2.raw
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccggcacgtccccaanacagggactgcagtggattggatacatctactcaggtcggaaccccaactaccaacccctcctcacggatccagtccgccatactccctggacctcgtaccaacaaccccagactcctccctgaaccgatcgacattcncgtcgacccgctcgcggacacagtccgtttattactgtgcgcgatcgtgggcactcgagtgactagtgtagtggacgtcgtggggaccgaagggccncgggtcacgttccgtcttcctcgacgcccgttccaccgaacgggccctaagtcccggtcttccccgtgccctaaccccg

SEQ ID NO: 342022 - DNA, 623 bp, Homo sapiens
  misc_feature: GZ8MTXP01ALMYW.4.12.B01.1.454.CMB.2.raw
  modified_base (247)..(247): a, c, t, g, unknown or other
  misc_feature (247)..(247): n is a, c, g, or t
  modified_base (391)..(391): a, c, t, g, unknown or other
  misc_feature (391)..(391): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcagtccccaanacgagggactgcagtggattggatacatctacttcagtcggaaccccaactaccaacccctccctcaggactccagtcgccatactcctggactcgtccaaacaaccccagatcctccctgaaccgatgacatctgtcgaccgntcgacgacacagtccgtttatacgtggtgcgtcgactcgtgggcctactcgtaagtgaccttaagtcggtaatgggtaaccggtcggtacgggggtacccaaagggggtccccaaacggggttcaacgttccggtacccttccgtacgaaccggttccccttaccgaaccccggtaacgggcccctaacgttccccgggtcccttcccccgtcgggaacccctaaccccccg

SEQ ID NO: 342023 - DNA, 617 bp, Homo sapiens
  misc_feature: GZ8MTXP01AD9MF.4.12.B01.1.454.CMB.2.raw
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (598)..(598): a, c, t, g, unknown or other
  misc_feature (598)..(598): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcagtccccaanacagggactgcagtggattgganacatctactcagtcggaaccccaactaccaacccctcctcaggactccagtcgccatactccctggacctcgtaccaacaaccccagactcctcccctgaacgatcgactactctgtcgaccgctgccggacacagtccgtttatacgtgtcgcgcgtatcgtacgggctactcggagtcgtactagttggtatcgggtacgttcggtgggggaccctaaggggacccctagggtcctacgttccggtccttcccgtaccgacggttccccgttacccgaacccggaaccggggcccctaaggttccccgggttcccctttccccccgngggttccccttaacccccg

SEQ ID NO: 342024 - DNA, 594 bp, Homo sapiens
  misc_feature: GZ8MTXP01A2U10.4.12.B01.1.454.CMB.2.raw
  modified_base (575)..(575): a, c, t, g, unknown or other
  misc_feature (575)..(575): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgcccctcacctgcactgtctctggtgcttcatggatggttactactggagttgggtccggcacgtccccaacacagggactgcagtggattggatacatctacttcagtcggaaccccactaccaacccctcctcaggactccagtccgccatactccctggactcgtaccaaacaaccccagactcctccctgaacgatcgactatctgtcgaccgctgacgacacagtcctttatacgtgtcgcgcgatcgtgggctactcggagtgactagtggtatcgggacgttcggtcggggaccgaaaggggccctaacgggtcaacgttccggtccttccgtacgacgccccttccgaacccggaacgggtccccaaggttccccgggtcccttcccccgnggttaacccctaacccccg

SEQ ID NO: 342025 - DNA, 576 bp, Homo sapiens
  misc_feature: GZ8MTXP01AWSG9.4.12.B01.1.454.CMB.2.raw
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagactctgtccctcacctgcactgtctctggtggcttcatggatggttactactggagttgggtccgcagtccccaanacagggactgcagtggattggatacatctactcagtcggaaccccaactaccaacccctcctcaggactccagtcgccatactccctggactcgtaccaaccgaaccagactcctccctagacntgacatctgtcgaccgctgccgacacgacgtccgtttattaccgtgtcgccgcgattccggtgggcgtacgtcgagtcgacgtagtggtagtgggtacgtcggtcgggggaccaaggggcccaacgggtcacgtccgttcctcctcacgttcccttaccgaaccgacgggccctaggtcccggttccttccccgttggaaccccc

SEQ ID NO: 342026 - DNA, 650 bp, Homo sapiens
  misc_feature: GZ8MTXP01AI8A1.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtaccccaanacgagggactgcagtggattggatacatctactcgagtacggaaccccactaccacccctcctcacggactccagtccgaccatactccgtaggacctcgtaccaaacaaccccagactcctccctagaaccgtatcgacacttcgtgtcgaccgctcggacgtacactacgttccgtttaatccgtagtcgacgtcgacttcgtgggcctactcggagtcgtactagtggtaagtcgggacgttcggacggggtacccgaacgggtacccgtacgggtccacgttccggttaccttcccgtaccgtaccgaccccgttacccgaaccccgggtaaccggggtccccctaaggtttcccccgggttcccttaccccccggtcggaaccccttaaccccccg

SEQ ID NO: 342027 - DNA, 591 bp, Homo sapiens
  misc_feature: GZ8MTXP01ANLVA.4.12.B01.1.454.CMB.2.raw
  modified_base (248)..(248): a, c, t, g, unknown or other
  misc_feature (248)..(248): n is a, c, g, or t
  modified_base (526)..(526): a, c, t, g, unknown or other
  misc_feature (526)..(526): n is a, c, g, or t
  modified_base (579)..(579): a, c, t, g, unknown or other
  misc_feature (579)..(579): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacgagggactgcagtggattggatacatctactcagtcggaaccccaactaccaaccccctcctcaggactccagtccgccatactccctggacctcgtaccaaacaaccccagtactcctccctgaacgatcgacatctgtcgaccgctcgacgaccacgtacgtcccgttttaataccgtggtcgtcgacgtatcgtggggacctacgtcgagtcgactaggtggtatcgggacttcggcgggggccaaaggggcccacgggtcacgttccgtccnccgcgacgccccttccgaccgaacgggccctaagtcccggtcccttaccccgngcccctaacccc

SEQ ID NO: 342028 - DNA, 637 bp, Homo sapiens
  misc_feature: GZ8MTXP01AG4HI.4.12.B01.1.454.CMB.2.raw
  modified_base (250)..(250): a, c, t, g, unknown or other
  misc_feature (250)..(250): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggtagttggggtccgcacgtccccaanacgagggactgcagtggattggatacatctacttcaggtacggaaccccaactacccaacccctccctcacggactccagtccgccatactccctaggactccgtaccaaacaaccccagactcctccctagaaacgtactcgacactacgtcgtacgaccgtctacggaccggtaacaccgtacgtccgttttaatacgtgtacgcgcgtacgtcgtagggacgtactcggagttgacttagtggttatcgggtaccgtcgtgggggaccctaagggccctaagggtcacgttccggtccncccgtacnccggcccttcccgaaaccggtaacccgggtccctaacggtcccggttaccccttcccccgcggcccctaaccccccg

SEQ ID NO: 342029 - DNA, 629 bp, Homo sapiens
  misc_feature: GZ8MTXP01ETAZJ.4.12.B01.1.454.CMB.2.raw
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (471)..(471): a, c, t, g, unknown or other
  misc_feature (471)..(471): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgctcatggatggttactactgggagttgggtccgcacgtccccaanacgagggactgcagtggattgganacatctacttcaggtcggaaccccaactaccaacccctcctcgaggacgtcacgtccgaccattactcccctggaccttccgtacccaacaacccccagactcctccctgaaccgatcgacatctagtcgacccgctcgggccgacacgcgttaccgtttattacgtggcgcgacgtatcggtcgggacctacgtacggntacgacttagtgggtacgtcgggaccgtcggtaacggggacccgaaacggggccctaagggtcctaagttcccgtcttacccgtcgcaccccgttccgaacccggtaacgggccctaacgtccccgggttcccttcccccgtcggcccctaacccccg

SEQ ID NO: 342030 - DNA, 655 bp, Homo sapiens
  misc_feature: GZ8MTXP01AUYID.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttcggggtccggcacgtaccccaacgacgaggggactgcaggtggatggatacatctactcacgtacggaaccccaactaccacccctcctacgaggactccagtcgacctatactccgtaggactacgtaccaaacaaccccagactcctccctgaaaccgatcgactactcgtagtcgaccgcgtacgaccgactacgtacgtaccgtttagtactggtcgcgacgtactcggtacgggcctactcggagtacgtaacttagtggtacgcgggtaccggttacggtcgggggaacccgtaacgggtaccgtacgggtctacgttccggtcccttccgtaacgaccgcccgttacccgaccggtaaccggggtcccctaacgggtttccccgggtccccttacccccggtggttcccctaacccccg

SEQ ID NO: 342031 - DNA, 918 bp, Homo sapiens
  misc_feature: GZ8MTXP01BIKVY.4.12.B01.1.454.CMB.2.raw
  modified_base (501)..(501): a, c, t, g, unknown or other
  misc_feature (501)..(501): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggattggttactacgtgggtaggttcgggtccggcacgtacccccaaagacgaggggactgcaggtggattggatacatctacttacacggtacggaaaccccctaactacccaaaccccctccctacgaacggaccgtaccaacggttcccgaccctaacttaccgttacccccgtaggtaacccttacccggtaacccaaaacccaaacccccgacgtaaccttccccgtaccccgtagaaaacccgtacttcggaaacctacgtccgttacggtacccgaaccccgggnttaccgggacccgggtaaacctaaccggtacggttacccgtttttaaaacgtaccggttacgggttccgggaccggtaccgttaacgtcccggggttacgggggaaccttaaccccggttgggaaaacgggtttccgggtaaaacctttagggggttaggggttaaaccgttcggggggtaaccgtttaccgggggtaccggggggtaaaccccgaaagggggttaacccccacgggggttaacctaaccggtttccccgggttccccttacccgttaaccgggaacccctttccccccggttaacccgaaaacccccgggggtaaacccggggtcccccttaaaccggggtttccccccggggttacccccttttacccccccggccggggttaaaccccctttaacccccccccg

SEQ ID NO: 342032 - DNA, 722 bp, Homo sapiens
  misc_feature: GZ8MTXP01A03M0.4.12.B01.1.454.CMB.2.raw
  modified_base (252)..(252): a, c, t, g, unknown or other
  misc_feature (252)..(252): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtggcttcatggatggttactacgtggtagttcgggccgcacgtaccccaanacgaggggactgctaggtggattggatacatctactcgacggtacggaaacccccaactacccaaccccctccctacgacgtacgtacccacgttaccgacctaacgttacctcccccgtaggtaccctacccgtaacccaaacctaaacccccgacgacttccctacccgtcgaaaacccgatcggaactacgtcttacggcgtacccgcgtacggaccggaacacggtacgttccgttttaatcggtacgtcgccgtagacgttcgcggggaccttacacgggtagttcgtaacttggtaggtacgtcgggtaccgttcggggtacggggaaccgtaacggggacccgtacgggtctaaccggttccgtcccttaccgaccgtaccggccccttacccggaaccggaacccgggtcccctaaccgggttccccgtcccctttcccccggcgttcccccttaacccccg

SEQ ID NO: 342033 - DNA, 579 bp, Homo sapiens
  misc_feature: GZ8MTXP01CJTS1.4.12.B01.1.454.CMB.2.raw
  modified_base (274)..(274): a, c, t, g, unknown or other
  misc_feature (274)..(274): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
  modified_base (490)..(490): a, c, t, g, unknown or other
  misc_feature (490)..(490): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttcgggtccgcacgtccccaagacaggggactgcaggtggattgganacatctacttcagtcggaacccccaactaccaacccctccctcacggacgtccagtcgccatactccgtgactcgtaccaacaaccccagactcctccctagaacgatcgactatctgtcgaccgntcgacgacacgngtaccgtttaatctgtagcgtcgatcgngggcactcgagtgactagtgtagtcggacgtcggtcgggaccagggtccncgggtctagttccgtcttccgtcgacgttcccgttcccgaccggaaccggccctaacgtcccggtcccttccccgcggccctaaccccg

SEQ ID NO: 342034 - DNA, 683 bp, Homo sapiens
  misc_feature: GZ8MTXP01A7AXS.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactgggtgaagccttcggagaccctgtccctcacctgcactgtctctggtgcttcatggatggttactacgtggtaggttcgggtccgcacgtaccccaagacgagggactgctaggtggattggatacatctactcgagtacggaacccctaactacccaaccccctccacgacggactaccagtccgcctactactcccgtaggtacctccgtaccaaaccaacccagactcctaccctagaaccatcgactctctcgtacgacccgtgtacggaccgaacacgtacgtaccgtttaactacgtggtcgcgacgtacgtccggtacgggctacgtggacgttacgtacttaggttcgggtacgtcggggtaccgttcggggtacgggggaaccccgtaaacgggggtaccccgtacgggtcctaaccgttcccggtcccttcccgtacgacccgttcccttaccgaacccggtaaccggtccctaacgttccccgggtccccttaccccggtcgaacccctaacccccg

SEQ ID NO: 342035 - DNA, 698 bp, Homo sapiens
  misc_feature: GZ8MTXP01AE6OW.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggtagttcgggtccgcacgtccccaanacgagggactgcagtggattggatacatctactcaggtacggaaccccaactaccaaccccctcctacacggacgtccacgtccgaccatactcccgtggacctccgtaccaacaaccccacgactccctccctagaacgatcgacatcgtcgtcgaccgtcgtaggacccggactaccgtacggttacccgttttaattacccgtggtacggtaccgtcggtaacgttcggttacggggaccgtaaacttccggggtaggtacgtaacgtttacggtacgggttacgtacggggtaccggttaccgggtacgggggaccctaaacgggggtaccctcgggtaactacgttcccggtaccttccgtcgaaccgttccccgttaccgaccggaaccgggcccctaacggtccccgggttcccttcccccggaacgccccgtaacccccg

SEQ ID NO: 342036 - DNA, 626 bp, Homo sapiens
  misc_feature: GZ8MTXP01AZF87.4.12.B01.1.454.CMB.2.raw
  modified_base (248)..(248): a, c, t, g, unknown or other
  misc_feature (248)..(248): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacgagggactgcagtggattggatacatctactcgagtcggaaccccaactaccaacccctccctcaggactccgagtccgaccatactccctggactcgtaccaacaaccccagactcctccctagaaccgatcgactactctgtcgaccgctcggacgacacgacgtccgtttattacgtgtcgcgtcgatcgtcgggctacgtcgagtgtactagtgtagtcggtacgtcggtacggggaccgaacgggacccgcgggtcctacgttccggttcccttcccgtaccgccgttccccgttacccgaacccgggaacccggggtcccctaaccgttccccgggtccccttccccccggtgggccccctaaccccccg

SEQ ID NO: 342037 - DNA, 652 bp, Homo sapiens
  misc_feature: GZ8MTXP01A566N.4.12.B01.1.454.CMB.2.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtgcttcatggatggttactagtggagttcgggtccgnacgtaccccaagaaggactgcagtgatggananatctactnaagtcggaaaccccaactaccaacccctccacgacgacgtccacggtccactactacgtccctggacctccgtaccaaacaaccagactcnccctgacgaactcgaactctcgtgcacgctcgacgacnctaagtcgttaatacgtgtcgcgtcgagtcgcggactacgtcacgggtgtaacttacgtggtacgtcggtccgttacgggaccgggggacaaacggggtccctaacgggtcctaacgttccggttcccttcccgacgtacccgtccccttaaccccgaaccgggttaacccgggtcccctaacgggtttccccggttcccccgtttcccccggcgggtccccccttaaccccgtttaaccccgg

SEQ ID NO: 342038 - DNA, 663 bp, Homo sapiens
  misc_feature: GZ8MTXP01EEQD3.4.12.B01.1.454.CMB.2.raw
  modified_base (253)..(253): a, c, t, g, unknown or other
  misc_feature (253)..(253): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaacgccttcggagaccctgtccctcacctgcactgtctcgtggtgcttcatggatggttactacgtggagttcgggtccgctacgtaccccaanacgaggggacctgcgaggtggattaggatacatctactcgacggtcggaacccccaactcgaccaaaccccctcctacgacggacttaccgagtccgccctatactcccgtaggtacctaccgtacccaaacccaaccaacgacttcccgtccctaaacgacgtaacttacgaacctatccgtagtacggaccgcgttcgacggtaccaacgtacggttaccctttttagtaaccgttggtacgccgacgtacgtcggtggaccgtaactcgtaagtacgtatagtgtaacgtggaaccgttggtacgggacaacgggccaaggttcacgtcgttaccgcctacacgttccccgttacccgaacggaaccgtccgacgtccccggttaccctcccgttaacggaaccccc

SEQ ID NO: 342039 - DNA, 634 bp, Homo sapiens
  misc_feature: GZ8MTXP01B070Y.4.12.B01.1.454.CMB.2.raw
  modified_base (281)..(281): a, c, t, g, unknown or other
  misc_feature (281)..(281): n is a, c, g, or t
  modified_base (401)..(401): a, c, t, g, unknown or other
  misc_feature (401)..(401): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggtttactacgtggtaggttcggggtccggcacgtaccccaacacgaggggactgcgagtggatgganacatctactcagtcggaaccccactaccaacccctcctcaggctccagtcgacatctcccgtggacctcgtaccaacaaccccagactcctcctgaacatcgacagttcagtcgaccgtntcggaccgacacgtagtacccgtttatacgtcgtcgcgtcgattccggtggctactggtagttagtactaggttggtacgtgggacgttacggtgggggaccctaacggggacccgtcgggtcacggttcgtcccttccgtacgacccgttccccgttccgttaaacccggaacccggggttcccaaccggtttccccggtcccgtttcccccgtcgggccccttaacccccg

SEQ ID NO: 342040 - DNA, 723 bp, Homo sapiens
  misc_feature: GZ8MTXP01AU3PT.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcagtggatggttactacgtggagttcgggccgcacgtccccaagcgagggactgcagtggattggatacatctactcagtacggaaccccaactacccaacccctcctacgacggactaccacgtccgactactactcccgtggacctcgtaccaaaccaaccccagtactacccgtaccccgtaggtaaaccgtacgtaacggacctaacgttcccgtacggtaccggaccccggtacgtcgggaacccggaaactaccgtacgggttacccgttttaatacggtcggttcggaccgtacgacgtccggtaggggacctacgtacgggtagtacggtacttagggtcgtaggtcgggtacgttacgggcggggaaccgtaaacggggtccctaagggtcctaacgttcccgtccgttcccgtacgtacccgggttccccttaccggaaccccggtaacccggggtcccttccgggttccccggtcccctttaccccggcggttccccttaacccccg

SEQ ID NO: 342041 - DNA, 673 bp, Homo sapiens
  misc_feature: GZ8MTXP01CXSUE.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtgtcttcatggattggttactacgtggaggttgggtccggcacgtaccccaacacgagggactgcagtggattaggatacatctactacgaggtacggaaccccctaactacccaaccccctcctacgacggactaccgagtccgacctatactccccgtagtacctcgtaccaaacaacccccgagtactcctccccgtagaaacccgatcgactactcgtgtacgaccgctcggaccgaactacgtacgttccgttaatttacgtacgtcgtacggtaccggacgtcgtcgggtcgtaccgtacgtacggttggtacgtacgttaggttggtacggtacgggtaccggtacggggtaccgggaacggtaccggaccgtaacgtcgttacgtcccgttcgaccgtcgccccttccgacccggaaccggtaccgtccgttccgtcccgttccccgtccgttccgtaaccccg

SEQ ID NO: 342042 - DNA, 564 bp, Homo sapiens
  misc_feature: GZ8MTXP02GI1J1.4.12.B01.1.454.CMB.2.raw
  modified_base (247)..(247): a, c, t, g, unknown or other
  misc_feature (247)..(247): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcacgtccccaancagggactgcagtggattggatacatctacttcagtcgggaaccccaactaccaacccctccctcaggactccagtcgccatactccctggactcgtaccaacaaccccagactctccctgaccgatcgacatctgtgaccgctgcgacacagtccgtttatactgtgcgcgatcgtggcgactcagtgactagtgtatggacgtcgtggggaccaaaggggaccacggtacacgtccggtcctccgtacacgaccctaccgaaccgaacgggcccctaacgtcccggttcccttcccccgtaggaccctacccccg

SEQ ID NO: 342043 - DNA, 559 bp, Homo sapiens
  misc_feature: GZ8MTXP02GFBU4.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactgggagttgggtccggcacgtccccaanacaggggactgcagtggattggatacatctacttcagtcggaaccccaactaccaacccctcctcaggactccagtccgccatactccctggacctcgtccaaacaaccccagactcctccctgaccgatcgacatctgtcgaccgctgcgacacacgtccgtttattactgtcgcgcgatcgtgggcactcgagtgactagtgtagtggacgtcgtggggaccaagggaccgaacggtcagtccgtctcctcgacgccctccgaaccgtaacgggcccacgtcccgtcctcccccgtgcccctaccccg

SEQ ID NO: 342044 - DNA, 615 bp, Homo sapiens
  misc_feature: GZ8MTXP02H95VT.4.12.B01.1.454.CMB.2.raw
  modified_base (248)..(248): a, c, t, g, unknown or other
  misc_feature (248)..(248): n is a, c, g, or t
  modified_base (275)..(275): a, c, t, g, unknown or other
  misc_feature (275)..(275): n is a, c, g, or t
  modified_base (367)..(367): a, c, t, g, unknown or other
  misc_feature (367)..(367): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggccaggactggtgaagccttcggagaccctgtccctcacctgcactgtctctggtggcttcatggatggttactacgtggagttgggtccgcacgtccccaanacaggggactgcagtggattggatacntctacttcagtcggaaccccactaccaacccctcctcgagactccagtcgaccatactccctggacctcgtaccaaacaaccccagactccncctagacgatcgaactatctagtacacccgctcggaccgaccaacgtacgtccctttaatactggtgcgacgacttcgtgggacctacttcaggtttagacttaggtgtaagtcgggaacgtcggtcggggacctaaacgggggacctaacgggttcacgttccgtcctacctcgaaccgtcccctaccaaccggaacgggcccctacgttcccgggtcccctttccccgcggtacccctaacccccg

SEQ ID NO: 342045 - DNA, 568 bp, Homo sapiens
  misc_feature: GZ8MTXP02J1FHL.4.12.B01.1.454.CMB.2.raw
  modified_base (247)..(247): a, c, t, g, unknown or other
  misc_feature (247)..(247): n is a, c, g, or t
  modified_base (504)..(504): a, c, t, g, unknown or other
  misc_feature (504)..(504): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcacgtccccaanacagggactgcagtggattggatacatctacttcagtcgggaaccccaataccaaccccctcctcaggactccagtcgccatactccctggacctcgtaccaaacaaccccagactcctccctgaccgatcgacatctgcgaccgctgacgacacacgtccgttttatactgtcgcgcgatcgtgggccactcagtgactagtggtatgggacgtcgtggggacccaagggacctacggtcacgtccgtccttcccncgaccgtccctaccgaaccgaaccggtccctacgttcccgtcccttccccgacgaccctacccc

SEQ ID NO: 342046 - DNA, 566 bp, Homo sapiens
  misc_feature: GZ8MTXP02I96FZ.4.12.B01.1.454.CMB.2.raw
  modified_base (247)..(247): a, c, t, g, unknown or other
  misc_feature (247)..(247): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (435)..(435): a, c, t, g, unknown or other
  misc_feature (435)..(435): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcacgtccccaancagggactgcagtggattggatacatctacttcagtcggaaccccaactaccaacccctcctcaggactcccagtccgccatactccctggacctcgtccaacaaccccagactctccctgacgatgacatcngtgaccgntgcgacacagtccgtttatactgtgcgcgatcgtggcgactcgagtnactagtgtatcccggtagtcgtggggacctaaggggccaacgggtcacgttcgtccgtacctcgacgtccctccgaaccgaacggggtccccagttcccgggtcctttacccccgtcggaccctacccccg

SEQ ID NO: 342047 - DNA, 569 bp, Homo sapiens
  misc_feature: GZ8MTXP02GTSXI.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccggcacgtccccaanacgagggactgcagtggattggatacatctactcagtcggaaccccaactaccaaccccctcctcaggacgtccagtcgccatactccctggacctcgtaccaacaaccccagactctccctgaccgatcgacatctgtcgaccgctgcgacacagtccgtttatactgtcgcgcgtatcgtgggacactcgagtgactagtggtatggtacgtcggtaggggccgaaagggacccacggtcagtccgtcgtcctacgacgcccctaccgaccgaacgggcccaacgttccggtcccttcccccgtggaccctacccccg

SEQ ID NO: 342048 - DNA, 539 bp, Homo sapiens
  misc_feature: GZ8MTXP02JUBRC.4.12.B01.1.454.CMB.2.raw
  modified_base (247)..(247): a, c, t, g, unknown or other
  misc_feature (247)..(247): n is a, c, g, or t
  modified_base (381)..(381): a, c, t, g, unknown or other
  misc_feature (381)..(381): n is a, c, g, or t
tcagagcactgtagcacgaccggtgctcgatttagtagtgtagattccgcgggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaanacaggggactgcagtggattggatacatctacttcagtgggaaccccaactacaacccctcctcaggagtcccagtcgccatatccctggactcgtccaacaaccccagatctccctgacgatcgacatctgtnacccgctgcgacacagccgtttattactgtgcgcgatctgggcgactcagtgactagtggtatggacgtcgtggggccaagggaccacgggtcagtcgtctcctcacgcctccaccaacgggccccaagtccggtccttcccccgtggcctacccccg

SEQ ID NO: 342049 - DNA, 534 bp, Homo sapiens
  misc_feature: GZ8MTXP02FJA4C.4.12.B01.1.454.CMB.2.raw
  modified_base (248)..(248): a, c, t, g, unknown or other
  misc_feature (248)..(248): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaanacaggggactgcagtggattggatacatctacttcagtcgggaaccccaactacaacccctcctcaggagtccagtcgccatacnccctggactcgtccaacaaccccagactctccctgacgatgacatctgtnaccgctgcgacacagccgtttattactgtgcgngatcgngggcgactcagtgactagtggtatggacgtcgtggggaccaagggaccacggtcagtcgtctcctcacgccctcaccgaaggcccacgtccggtcctcccctggcctacccc

SEQ ID NO: 342050 - DNA, 595 bp, Homo sapiens
  misc_feature: GZ8MTXP02F5K41.4.12.B01.1.454.CMB.2.raw
  modified_base (246)..(246): a, c, t, g, unknown or other
  misc_feature (246)..(246): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcagtccccaanacagggactgcagtggattggatacatctacttcagtcggaaccccaactaccaacccctcctcgaggacgtccagtccgaccatactcccgtggacctcgtaccaaacaaccccagactctccctgaccgatcgacatctgtcgaccgctggaccgacaccagtccgttttaattaccngtcgcgcgatcgtgggccactcgagtnacttagtggtatgggaccttggtcggggaccaaggggaccctacgggtctacgtccgtcctcctacgaacgtcccctaccaacccggtaacggccccctaaggttccccggttcccttacccccggtggccccctacccccg

SEQ ID NO: 342051 - DNA, 609 bp, Homo sapiens
  misc_feature: GZ8MTXP02G8B7T.4.12.B01.1.454.CMB.2.raw
  modified_base (248)..(248): a, c, t, g, unknown or other
  misc_feature (248)..(248): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacagggactgcagtggattggatacatctactcagtcggaaccccaactacaacccctcctcaggacgtccagtcgccatactccctggacctcgtaccaaacaacccagactcctacctagacgatcgactactctcgtcgaccgctcggcgacacacgtccgtttatacgtgtcgcgacgtatcgtcgggacgacttgagtgactagtggtaatcgggtacgtcgtacgggggacctaaggggaccctacggtcgtacgttcccggttacctcccgtactaccggccccttacccgaaccgtaaaccgggcccctaacggtcccggttcccttcccccggtacggacccctaacccccg

SEQ ID NO: 342052 - DNA, 606 bp, Homo sapiens
  misc_feature: GZ8MTXP02G9SXW.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccgcacgtccccaanacagggactgcagtggattggatacatctacttcagtcggaaccccaactaccaacccctcctcaggagtccagtcgccatactcctcggactcgtaccaacaacccagactctcctgaccatcgacatctgtcgaccgctcgcgacacgacgtccgtttatactgtcgcgcgtactcgtcggcgactcgagtagacttagtggttaacgtgggtaccggttcggtacggggaccgaaacggggtaccgtacggtacgacgttccggttcctcccgtcgaacgtccctacccgaccggaaaccggggtcccctacgttcccggttcccccttccccggtacggtcccctaacccccg

SEQ ID NO: 342053 - DNA, 592 bp, Homo sapiens
  misc_feature: GZ8MTXP02IGEMD.4.12.B01.1.454.CMB.2.raw
  modified_base (248)..(248): a, c, t, g, unknown or other
  misc_feature (248)..(248): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacagggactgcagtggattggatacatctactcagtcggaacccaactaccacccctcctcagactcagtcgaccatactcctgactccgtacaacacccagactctcctagacgatgactatctcgtacgccgctcggacgtacacgtacgtaccgtttacttaccgtgtcggcgcgtagtcgtcgggaccgtactcgaggttagtacttacgtggtagtacgggtacgttcggtcggggaccgaacggggaccgtacggttctacgttccgtcctccgtcaccgtccctaccaccgaaccgggtccacgttccggtcccttccccgcggtccctaacccccg

SEQ ID NO: 342054 - DNA, 613 bp, Homo sapiens
  misc_feature: GZ8MTXP02HEGPR.4.12.B01.1.454.CMB.2.raw
  modified_base (248)..(248): a, c, t, g, unknown or other
  misc_feature (248)..(248): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccggcagtccccaanacgagggactgcagtggattggatacatctactcagtcggaaccccaactaccaacccctcctcaggactccagtcgccatactccctggacctcgtaccaaacaaccccagactcctccctgacgatcgacatctgtcgaccgctcgacgacaactacgtacccgtttattacctggtcgcgcgatcgtggggaccactcgagtgaacttagtggtagtcgggaccgtcggtcgggggacccgaaaggggacccgaacgggtcaacgttccggtacctcccgtacgaccggtcccctacccgaaaccggaaaccgggcccctaacgttcccggtaccctttcccccgcggtaccctaacccccg

SEQ ID NO: 342055 - DNA, 623 bp, Homo sapiens
  misc_feature: GZ8MTXP02IOVLQ.4.12.B01.1.454.CMB.2.raw
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtccccaggtgcagctgcgggagtcgggcccaggactggtgaagccttcggagaccctgtccctcacctgcactgtctctggtggcttcatggatggttactactggagttgggtccggcacgtccccaacacaggggactgcagtggattggatacatctacttcagtcggaaccccaactaccaacccctcctcaggactccagtccgccatactccctggacctccgtacaacaaccccagactctccctgacgatcgacatctgtcgaccgctcgcgacacgagtccgtttattacgtgtgccgngatcgngggcactcgagtgacttagtggtagtgggacgttcggtacggggaccgtaaacggggacccacgggtacctaacgttccggtcccgttaccctacgtaccgtaccccttacccaaacccggtaaacggggccccctaacggttcccccggggtaccctttccccccggttcggaccccctaaccccccg

SEQ ID NO: 342056 - DNA, 671 bp, Homo sapiens
  misc_feature: GZ8MTXP02JNMXU.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccgcacgtccccaanacaggggactgcagtggattggatacatctactcagtcggaaccccaactaccaacccctcctacaggactccagtccgaccatactcccgtgacctcgtaccaacaaccccagactcctcctgaccgatcgacatctagtcgaccgctcggaccgacaccgtacgtcccgtttattaccgtgtcgacgcgatcggtggaccgtacttcgaggttacgtacttaggtaggttaagcgggtaaccgttcgggtcgggggaaccgtaaacgggggtaccctaacggttcgtaaccgtttccggttaccctaccgttcccgaaccgttccccctaacccgaaaccccggaaacggggtccccctaacggtttcccccggggttaccccttttccccccggacgggtcccccctttaaaccccccg

SEQ ID NO: 342057 - DNA, 565 bp, Homo sapiens
  misc_feature: GZ8MTXP02IHK9V.4.12.B01.1.454.CMB.2.raw
  modified_base (250)..(250): a, c, t, g, unknown or other
  misc_feature (250)..(250): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
  modified_base (503)..(503): a, c, t, g, unknown or other
  misc_feature (503)..(503): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccggcacgtccccaanacaggggactgcagtggattggatacatctacttcagtcggaaccccaactaccaaccccctcctcaggacgtccagtccgccatactccctggacctcgtaccaacaccccagactactcccngacatgacatctgtcgaccgntcgcgacacagtccgtttatactgtcgcgcgtatcgtgggctactcagtnacttagtaggtatggacgtcgtcggggaccgaagggaccgacggtcatccggtctccncgacgccctaccgaccgaacgggtcccacgttccgtacccttcccccgtgaccctacccccg

SEQ ID NO: 342058 - DNA, 574 bp, Homo sapiens
  misc_feature: GZ8MTXP02IWN1Z.4.12.B01.1.454.CMB.2.raw
  modified_base (248)..(248): a, c, t, g, unknown or other
  misc_feature (248)..(248): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaanacgagggactgcagtggattggatacatctacttcagtcggaaccccaactacaacccctcctcaggactccagtcgccatactccctggactcgccaacaaccccagactctccctgaccgatgacatctgtcgaccgctgcgacacagtcctttattacgtgtcgcgcgtatccgtgggaccgacttcgagtgacttagtaggtagtggacgttcgtacgggggccaaggggaccacggtcagttccggtctccgtcgacgccctaccgaaccgaacgggccccaacggttcccggtcctttcccccgtaggccctaacccccg

SEQ ID NO: 342059 - DNA, 583 bp, Homo sapiens
  misc_feature: GZ8MTXP02JWQX3.4.12.B01.1.454.CMB.2.raw
  modified_base (572)..(572): a, c, t, g, unknown or other
  misc_feature (572)..(572): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccggcacgtccccaacacgagggactgcagtggattggatacatctacttcagtcggaaccccaactacaaccccctcctcaggactccagtcgccatactccctggacctcgtacccaaacaacccccagactccctccctagaaccgattcgactattctgtcgacccgtctggaccgacacgtacgtccgtttatacgtgtgccgtcgatcgtgggacctactcgagtgacttaggtgtagtggtacgtcggtcggggaccaaggggacccacgggtacacgtccgtctccgacacgtccctacaccgaacggcccagtcccggtcctaccccgngccctaccccg

SEQ ID NO: 342060 - DNA, 654 bp, Homo sapiens
  misc_feature: GZ8MTXP02HC5M1.4.12.B01.1.454.CMB.2.raw
  modified_base (252)..(252): a, c, t, g, unknown or other
  misc_feature (252)..(252): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggattggttactacgtggtagttcgggtccggcacgtccccaanacgagggactgcagtggatggatacatctactcgagtacggaaccccaactaccaaccccctcctacgaggactccagtccgaccatactccctggacctcgtaccaaacaaccccagtactcctaccctagaccgtatcgacatccgtgtcgaccgctacggccgaactacgacgttacccgtttatacccgtggtcgcgtacgtacgtcgtacgggacctactcgaagttcgtaattagggtagttacgtacgggaccgtttcgggacggggaacccgtaaacggggccctacggggttacacgtttcccgtacctaccgtacgaccggtacccctaccgaacccggtaaccggtccctacggttccccggtacccttcccccgtaggcccctacccccg

SEQ ID NO: 342061 - DNA, 558 bp, Homo sapiens
  misc_feature: GZ8MTXP02JZY1O.4.12.B01.1.454.CMB.2.raw
  modified_base (248)..(248): a, c, t, g, unknown or other
  misc_feature (248)..(248): n is a, c, g, or t
  modified_base (402)..(402): a, c, t, g, unknown or other
  misc_feature (402)..(402): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaanacagggactgcagtggattggatacatctacttcagtcggaaccccaactaccaacccctcctcaggacgtccagtcgccatactccctggacctcgtaccaacaaccccagactcctccctgaccatcgacatctgtcgaccgctgcgacacncgtccgtttatactgtgcgcgatcgtgggcactcgagtgactagtggtatgggacgtcggtggggccaaggggccacgggtcacgtccgtctcctcgacgtccctaccgaccgaacgggccccagtcccggtcctcccccgtcggaccctaccccg

SEQ ID NO: 342062 - DNA, 684 bp, Homo sapiens
  misc_feature: GZ8MTXP02H8D56.4.12.B01.1.454.CMB.2.raw
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaanacgagggactgcagtggatggatacatctactcagtcggaacccactacacccctctcagctccagtcncatctccngactcgtacaacacccagactcctacctagacgatcgactatcgtagtcgaccgctcgacgacacgtacgtaccgtttatacgtggtacgcgacgtacgtcgcgggtacgacctacgaggttcgtaaccttagggttacggggttaacgttcgggggtaaccgttcggggtaccgggggtaacccggtaaacgggggtacccccgtaacggggttacctaacggttccccggttacccgttacccgtacgtaccccggttaccccgttacccccgaaacccggtaaaccgggggcccccttaaacgggttcccgggttccccctttaccccccggttcggaccccctttaaccccccgg

SEQ ID NO: 342063 - DNA, 814 bp, Homo sapiens
  misc_feature: GZ8MTXP02JB2IW.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccggcacgtccccaanacgaggggactgcagtggattggatacatctactcgagtcggaaccccaactaccaaccccctcctacgaggacgtccagtccgccactacctcccgtacggtacctaccggtaccctaaaccaaccccgtagtacctccttacccccgtaggaaccgtacttcgaacctacttccgttacgtaccgtaacccgtccgttacgggacccggaacctaaccggtacgtttacccgttttaaacgttaaccgtcggttacggcccggtacgtaacgttccgggtacgggggtaaccgtaccgttacggtaaacggttcggtaacccgtttaaggtttacgggggttaacgttccgggggtaaccgtttccgggggtaccgggggaaaccccgtaaaacggggggtaacccccgtaaccgggggtttaccaaacggtttcccggttaaccctcccgttaaccggacccgtacccccgtacccgaaaacccggaaccgggggtcccccttaacggtttccccgggttaccccctttccccccggtaacgggtcccccttaaaccccccg

SEQ ID NO: 342064 - DNA, 641 bp, Homo sapiens
  misc_feature: GZ8MTXP02GXSWV.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtgggagttgggtccgcacgtccccaanacgagggactgcagtggatggatacatctactcagtacggaaccccaactaccaacccctcctacacggcgtccagtcgaccatactccgtggactccgtaccaacaacccagactcctcctgacgactcgacatctgtcgaccgtctcgacgacaccgtagtacccgtttattacgtgtcgcgcgtacgtcgtagggacacttgacgttgacttaggtaggttagtcgggtaacgtcggtacgggggacccaaacggggtaccgtaccgggtactacgtccggttacctcccgacgtacccgtaccccgtaacccgaacccgtaaccggggtcccctaacgggttccccgttacccccgtttcccccgaccgggaccccttaaccccccg

SEQ ID NO: 342065 - DNA, 666 bp, Homo sapiens
  misc_feature: GZ8MTXP02H9FL3.4.12.B01.1.454.CMB.2.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctccacctgcactgtctctggtggcttcatggattggttactacgtggtaggttcgggtccggcacggttcccccaaacgtacgaggggactgcaggtggattggatacatcctactcaggtacggaaaccccactaccaaccccctcctnaggactccagtccnccatactccngacctccgacaaacaccagtactcctccctgaacatcgactatccgtgtacgacccctgtcggaccgaacaccgtagtaccgttttactacgtgtcgcgcgtatcgcgggtacacttacgaggttgaacttaggtggtacgtcgggacgttcggacggggtaccgaaagggtccctaacgggttacaccggttccttccgttaacccctcggacccgtaccccgttaccccgaaaacccgggtaaccggggccccctaacggtttcccccgggttccccctttccccccggaggtcccccttaaccccccg

SEQ ID NO: 342066 - DNA, 656 bp, Homo sapiens
  misc_feature: GZ8MTXP02I4PHO.4.12.B01.1.454.CMB.2.raw
  modified_base (250)..(250): a, c, t, g, unknown or other
  misc_feature (250)..(250): n is a, c, g, or t
  modified_base (391)..(391): a, c, t, g, unknown or other
  misc_feature (391)..(391): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggaggttgggtccggcacgtccccaanacgagggactgcagtggatggatacatctactcagtacggaaccccaactaccaacccctcctacaggacgtccagtccgaccatactcccgtggacctcgtaccaaacaaccccagtactcctccctagacgatcgactntctagtcaccgctggaccgtacactacgtccctttaattacgtgtcgcgtacgtacgtcgtgggaccactcgtaagtgtaacgttaggtaggtaacgtcgggtaaccggtcgggtacggggacccgtaaaggggcccgtaacgggtcacgttcccggtcctacccgttacgaccggtaccctacccggaacccggtaaccgggtacccccttaacggttcccccgggttccccttacccccggtacggaccccttaaccccccgg

SEQ ID NO: 342067 - DNA, 624 bp, Homo sapiens
  misc_feature: GZ8MTXP02F9JFX.4.12.B01.1.454.CMB.2.raw
  modified_base (247)..(247): a, c, t, g, unknown or other
  misc_feature (247)..(247): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccgcacgtccccaanacgagggactgcagtggattggatacatctacttcagtcggaaccccaactacaacccctcctcaggagtccagtcgccatactccctggacctcgtaccaacaaccccagactcctccctgaccgatcgacatctcgtgaccgctcgcgacacacgtccgtttattacgtgtgcgcgatcgnggcactcgagtgacttagtgttaancgggtacgtcgtacggggacctaaagggggccctaacgggtcctaaacggtttccgtcctttacccgacgacgtaccccgttaaccgaaaacccggaaacgggggtccccctaaacggtttccccgggttaccccttttccccccggcggtaccccgttaaaccccccg

SEQ ID NO: 342068 - DNA, 598 bp, Homo sapiens
  misc_feature: GZ8MTXP02HAV2H.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggagttgggtccgcacgtccccaacacgagggactgcagtggattggatacatctactcagtacggaaccccaactaccaaccccctccctacgacggacgtccagtccgaccatactccctggacctccgtaccaaccaaccccagtactcctcctagaccgatcgactatctgtacgaccgctcggccgacacgtacgtccgtttaattaccgtgtcgcgtcgtacgtcgtcgggccacttcgagtcgacttagtgtagtcggtacgtcggtacgggaccgaagggaccgtacggtcacgtcgtcctcctacgacgtccctaccgaccgaacgggccctacgtcccgtcccgtccccgtcggaccctaccccg

SEQ ID NO: 342069 - DNA, 612 bp, Homo sapiens
  misc_feature: GZ8MTXP02FWNAT.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggattggttactacgtggagttgggtccggcacgtccccaanacgagggactgcagtggattggatacatctacttcagtacggaaccccaactaccaacccctcctacaggacgtccagtccgccatactcccgtgacctcgtaccaaacaaccccagactctcctgacatcgacatctgtacgaccgctcgaccgacactacgtaccgttttaatacgtgcgcgacgtatccgtgggaccgtactcgaagttcgaacttaggtaggtacgtgggtaaccggtcggtacgggggaaccgaaacggggtacccaacgggtactacgttccgtcctaccgtacgaccgcccctaccgaaccgaacggccctaacgtcccggtcccttccccgcgaccctaccccg

SEQ ID NO: 342070 - DNA, 710 bp, Homo sapiens
  misc_feature: GZ8MTXP02GRZ3G.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggattggttactacgtggagttgggtccgcacgtccccaacacgagggactgcagtggattggatacatctacttcgaggtcggaaccccaactacccaaccccctccctacgacggactcccacggtccgacccaacttacctccccgtacggaacccttccggtaaccccaaaccaaacccccgtagtaccttccctccccgtagaaccgatcgacctaacttccgtagtacgaacccgctacggaccgaactacgtacgttacccgtttaattacgttgtcggcgtacgtacgtcgtaggggacactacgaggtcgacttagtagtagtacgggtaccgtcgggtaacggggaccgtaaacggggtccgtaaccgggttactaccggttccggtaccctcccgttaccgtacccgaccccttacccgaaaaccgtaaccggggtcccctaaaccgttcccggtaccccctttacccccggccggtacccctaacccccg

SEQ ID NO: 342071 - DNA, 581 bp, Homo sapiens
  misc_feature: GZ8MTXP02F5CHB.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccgcacgtccccaacacgagggactgcagtggatggatacatctacttcagtcggaaccccaactaccaacccctcctcaggactccagtcgccatactccctaggactcgtaccaacaacccagactctcctgacatcgacatcgtgtcgaccgctgcgacacagtaccgtttatacgtagtcgcgcgtatcgtgggcgtactcgagtgactagtaggtactgggactcggtacggggccgtaaagggaccgacggtactacgtccgttctccctacgaccgtccctacccgaaccgaacgggccctacgtcccggttcccttacccccgtcggaccctacccccg

SEQ ID NO: 342072 - DNA, 620 bp, Homo sapiens
  misc_feature: GZ8MTXP02GHLOD.4.12.B01.1.454.CMB.2.raw
  modified_base (252)..(252): a, c, t, g, unknown or other
  misc_feature (252)..(252): n is a, c, g, or t
  modified_base (550)..(550): a, c, t, g, unknown or other
  misc_feature (550)..(550): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggattggttactacgtggtagttgggtccggcacgtccccaanacgagggactgcagtggattggatacatctacttcaggtacggaacccctaactaccaaccccctcctcgaggactccagtccgccatactccctaggactccgtaccaaacaacccctagactcctccctagacgtatcgacatccgtagtcgaccgcgtgaccgaacacctacgtaccgtttattaccgtgtcgcgtacgtacgtcgtagggccgaacgtcgagtacgacttagttcggtagtcgggtacgtcggtacggggaccgtaagggaccacggtcacgttccgtcctccncgaccgtccctccgaacccggaaccggtccctacgtcccgttacccgttcccccgtggacccctaccccg

SEQ ID NO: 342073 - DNA, 551 bp, Homo sapiens
  misc_feature: GZ8MTXP02HRSHH.4.12.B01.1.454.CMB.2.raw
  modified_base (247)..(247): a, c, t, g, unknown or other
  misc_feature (247)..(247): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactactggagttgggtccggcagtccccaanacaggggactgcagtggattggatacatctacttcagtacggaaccccaactaccaacccctcctcagactccagtcgccatactcctggactcgtccaacaaccccagactctcctgaccgatgactatctgtcgacccgctcgaccggacacacgtccgtttattactgtcgcgcgatcgtgggcgactcagtgactagtgtagtggacgtcgtggggccgaacgggacgacggtcacgtccgtctcctcacgccctaccacgaacggccacgtccggtccttccccctcggacctaccccg

SEQ ID NO: 342074 - DNA, 684 bp, Homo sapiens
  misc_feature: GZ8MTXP02F253N.4.12.B01.1.454.CMB.2.raw
  modified_base (253)..(253): a, c, t, g, unknown or other
  misc_feature (253)..(253): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtgtcttcatggattggttactacgtggagttgggtccggcacgtaccccaanacgaggactgcgagtggagttggatacatctacttcgacggtaccggaaccccaactacccaaccccctcctacgacggactaccagtccgaccatctcccgtaggtacctccgtaacccaaaccgaaccccacgtacctcctaccctagaaccgtatcgaactacttcgtacgtaccgaccgtcgtcggacgactacgtcgttaccgtttatccgtagtcgcgtacgtattcgggcggacctactgtacgtgtaacgttaggtgtaacgtcgggtacgttcgggacgggaccgaacgggtacctcggtactacgttccgtacctccgtacgacccgtaccccttaccgaaaccccggtaaccggggtaccccttaaccgggttcccccggttaccccctttcccccggtaccggaccccctttacccccg

SEQ ID NO: 342075 - DNA, 631 bp, Homo sapiens
  misc_feature: GZ8MTXP02I9IKR.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggattggttactacgtggagttgggtccgcacgtccccaanacgagggactgcagtggattggatacatctacttcacgtacggaaccccaactaccaaccccctcctcgaggactcccagtccgccatactccctaggacctccgtaccaacaacccagactcctccctagaccgtatcgaacctacgtcctagccgaaccgcgtacggccgacacgtcgtaccgtttaatcgtgcgcgagactcgtcggactctaccgaggttcgacttagtacggtatcggacgtggtacggggacaacggggcacgggtactacgtccgtctaccgtacgccgtacccgttacccgaacggaaccggtcccccttaacgttcccccgggttacccctttccccccggcggtacccccttaacccccgg

SEQ ID NO: 342076 - DNA, 597 bp, Homo sapiens
  misc_feature: GZ8MTXP02IDIFC.4.12.B01.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactatggagttgggccgnacgtccccaanacagggactgcagtggattggatacatctacttcagtcggaaacccccaataccaaccccctcctnaggactcccagtccgcatactcctggactccgtaccaacaaccccagactcnccctgaccgangacatctgtgacccgntacgcgacacgacgtccgtttattacctgtcgcgacgatcgnggcgactcagttagactagtgtatggacgtgtcggggactaggggacctaacggtcagttccgtccttccgactaccgcccttaccgaaacccggtaaaccggggccccctaacgttccccggggttcccctttacccccccgtgggtaccccttacccccccgg

SEQ ID NO: 342077 - DNA, 677 bp, Homo sapiens
  misc_feature: GZ8MTXP02JGT9F.4.12.B01.1.454.CMB.2.raw
  modified_base (252)..(252): a, c, t, g, unknown or other
  misc_feature (252)..(252): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggtagttcggggtccgcacgtccccaanacgagggactgcaggtggatggatacatctactcgagtacggaaccccaactaccaacccctcctacacggacgtccagttccgcctacgtactcccgtaggtacctccgtacccaacaaccccagtactcctcctacgacgtatcgaactactactcgtacgacccgctcgaccggacctaactacgttaccgtttaacttaacgtgttcggacggtacgtacgttccgtaggggacctaccgtagtacgtacgacttaaggtcggtaaacggtgggaccgtcgggtacgggggaccgaaacggggtaccgtaaccgggtctacgttacccgtccgtccgtacgacccgtcccctaccgaaacccggtaacggtccccaacgttaccccggtccctttacccccggtcggaccccttacccccg

SEQ ID NO: 342078 - DNA, 749 bp, Homo sapiens
  misc_feature: GZ8MTXP02G6UYK.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtgcttcatggatggttactacgtggtagttgggccggcacgtccccaacacgaggactgacaggtgatggatacatctactcgagtacggaaccccaactacctaaccccctccctacgacggacgtacccacggtccgacctacttaacgtcccctagggtaaacccttcccggtaaacccaaaaccaaaaccccctaacggtaccttacccgtacccccgtaggtaaaccgaacgttacgaaccctaacggttaccgttacgggttaccgtaaccccgggtccgttacgggacccgggaaaccaccgttacggttacccgttttaacgtacgtcgtacgcgtacgtactcggtggaccctccgttagacgttgaacgttgtaggtacgtcgggtacccgtgggtaccggggaacgaaccgggggtactaccgggtactacgttccgttcctacccgtacgaccgtcccccgtaacccgaaccggaaccggtacccctaccggtttcccggtaccccctttacccccgcggtaacccccttacccccg

SEQ ID NO: 342079 - DNA, 655 bp, Homo sapiens
  misc_feature: GZ8MTXP02FP1MN.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccgcacgtccccaanacgagggactgcagtggaattggatacatctacttcagtcggaaccccaactaccaacccctcctcaggacgtccagtccgccatactcccgtggacctcgtaccaacaaccccagtactcctccctagaccgatcgacatcgtagtcgaccgctcgcgacacgtacgtccgttttatacgtgtcgcgcgtagtcgtggggactactcgagtcgtacttagttggttaacgtgggtaaccgttggtacgggggacccaaacgggggacccacggggttaccagttcccggtcctacccgtacgtaacccggtcccctaaccccgaaaccggtaaaccgggggtccccctaaacggttccccggggttacccctttccccccggtaacggtcccccttaaccccccg

SEQ ID NO: 342080 - DNA, 720 bp, Homo sapiens
  misc_feature: GZ8MTXP02F4ZRD.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtggcttcagtggattggttactacgtgggtaggttcgggtccggcacgtccccaacacgaggggactgcgaggtggattggatacatctactcgacggtaccggaaaccccaactacccaaccccctcctacgacggtactacccgagtcccgacctaactaccctcccgtacggtaccctccgtaacccaaaaccaaccccgaacgtacctaccctacccccgtagaacccggtaacttcgaacctaacttccgtaccgtaccgaacccgtcgtacggacccggtaaccacgtacgttaccgtttagttacgtgtacgcgtacgtcgtacgtgggacctacgtcgtaagtcgtacttaggttagtacgtcggtacgtcgggtacgggaccgaaacggtacccgacggtacacgttccgtacctcccgtaccgccgtacccgtaacccgaaaccggaacccggtccctaacggttcccccggttaccccttaccccggtccgaccccgtttaacccccg

SEQ ID NO: 342081 - DNA, 613 bp, Homo sapiens
  misc_feature: GZ8MTXP02HM497.4.12.B01.1.454.CMB.2.raw
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
  modified_base (415)..(415): a, c, t, g, unknown or other
  misc_feature (415)..(415): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaggccttcggagaccctgtccctcacctgcactgtctctggtgcttcatggatggttactacgtggagttgggtccgcacgtccccaacacgagggactgcagtggattggatacatctactnacgtcggaaccccaagtcgaccaacccctccctcaggactcccaggtccnccaatactccccgtaggacctcgtaccaacccaaacccagtactccttacccagacgtactcgaacattctgtcgaaccgtcncgaccggacacgtacgtccgtttaacttacgtgtcgcgcgatcgtagggcactacgtagtcgataagttggtacgtggacgttcggtacggggaccgaacgggaccgtaacggtctacgtccgtcctcccgtacgaccgtcccgtaccaaccgtaacggaccctacgtcccggttccccgttccccgtccggtacccc

SEQ ID NO: 342082 - DNA, 650 bp, Homo sapiens
  misc_feature: GZ8MTXP02JG69W.4.12.B01.1.454.CMB.2.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactacgtggagttgggtccgcacgtccccaanacgagggactggcaggtggattggatacatctactcagtacggaaaccccactaccaacccctcctcaggctccagtcgccatactccgtggacctcgtaccaacaaccccgagactcctcctgaacgntcgacntctgtgaccgctacgccgacacgtagtaccgtttataccgtgtcgacgcgtatccgtggggactacgtcgaaggtcgtaactaggttaggtacgtacggtaccgggttcggtacggggaccccgaaacggggtaccgaaccgggttcaaccgtttccggtaccttcccgtaccgacccgttaccccgacccgaaacccggtaaccggtacccctaaccggttccccggttccccgtaccccggttaccggcccccttaacccccgg

SEQ ID NO: 342083 - DNA, 643 bp, Homo sapiens
  misc_feature: GZ8MTXP02HSDP5.4.12.B01.1.454.CMB.2.raw
  modified_base (249)..(249): a, c, t, g, unknown or other
  misc_feature (249)..(249): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtcctcacctgcactgtctctggtgcttcatggattggttactacgtggagttcgggtccgcacgtccccaancgagggactgcagtggattggatacatctacttcagtacggaacccactaccaacccctcctcgaggacgtaccagtccgaccagttactcccgtggacctccgtaccaacaaccccagtactcctaccctgaccgatcgacactcgtcgtcgacccgtctcgacgacaactcgtcgtttacttcgtagtcgcgacgtacgtcgtcgggactactccgtagttacgacgttaggtagttagtcgggaccgttcggacggggaccaacgggggtaccacgggtactacggttccgtacctcccgttacgacccgcccttaccccgaaaccggtaaccgggtacccctacggtttccccgggtacccctttcccccggacggtacccctacccccg

SEQ ID NO: 342084 - DNA, 712 bp, Homo sapiens
  misc_feature: GZ8MTXP02IL1XF.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggccaggactggtgaagccttcggacgaccctgtccctcacctgcactgtctcgtggtgcttcatggattggttactagtggtagttgggccgacacgtaccccaagacgagggctgctaggtggtataggactactatctactcgaacgtacggaaccccaactaccacccctccagacgactcgacgtacgacctatcctccgagtacctccgtaaacaaccaacccgaagtaccttcccgtaccgtacgtaacgtactacgtactacttaccgttacgaccgtaccgtacgtaccggaccggaactaccggttacggttaaccctttaagttaccgtggtacggccgtaagtaccgtacgggtcgggaacccttacgtaacgaggttaaccgtaagttggtaacgggtcgtacgggtaccggttacgggaacggggaaccgtaaaaccgggtccgtaacgttacgtccgtccggtacttacccgacgtccgaccccttaaccgaacggtaaccggtaccctcggtttacccccggtaccttcccccggacgaccccttaaccccg

SEQ ID NO: 342085 - DNA, 691 bp, Homo sapiens
  misc_feature: GZ8MTXP02G6BLH.4.12.B01.1.454.CMB.2.raw
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctcgtggtgcttcagtggattggttactacgtgggtaggttcgggtccggcacgtccccaaanacgagggactgcgaggtggatggatactatctactcacggtacggaaccccaactaaccacccctcctcgaggacgtccacgtcgacctactctccgtcgtacctacgtaccaacaacccacgactcctaccagacacngactatctcgtacgaccgcgtcgacccgaacncgtaacgttcgtttactagtcgtcgcgacgtacgcggttcgggactacgttacgtacgttacgtaacgttaggttaacgggttagttacggggtaccgttacggggttaccgggggaacccgttaaacgggggaccccgttaacgggtactacccggttaccgttccccgtaccttaccgacccgtacccgtaacccgaaccggtaaccgcccgttacggttccccgttccccgttacccccgtccggtaacccctacccccg

SEQ ID NO: 342086 - DNA, 723 bp, Homo sapiens
  misc_feature: GZ8MTXP02JBVJU.4.12.B01.1.454.CMB.2.raw
  modified_base (620)..(620): a, c, t, g, unknown or other
  misc_feature (620)..(620): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggacgaccctcgtccctcacctgcactgtctctggtggtcttcagtggatggttactacgtggtagttgggtccgcacgtaccccaagacgagggactgcgagtggattgatacatctacttcgacgtacggaaccccaactaccaacccctcctacgacggtactccacgtccgaccacgttactcccgttacggacctccgtaccaaacctaaccccagaccttaccctcccgttacgaacgtaactcggaacctacgttctacggttaccgaaccgctacgggaccggaactaccgtaacgttcccggtttattaccgtggtccgacggcgtacgtcgtggggaaccctacttacggacggttgaaaccgttaggttacggtaggtccggtaaccggttgggtaccgggggaccgaaacgggggtaaccctcgggtacgacggtttcccnccgttaccgaccgacccgtccccgtaaccgaacccgggaaccgggtccccttaacggttccccggttaccccgtttcccccggacggtacccctaacccccgg

SEQ ID NO: 342087 - DNA, 650 bp, Homo sapiens
  misc_feature: GZ8MTXP02GIIQT.4.12.B01.1.454.CMB.2.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (422)..(422): a, c, t, g, unknown or other
  misc_feature (422)..(422): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcggggagtcgggcccaggactggtgaagccttcggagaccctgtccctcacctgcactgtctctggtggcttcatggattggttactacgtggtaggttcgggtccgcacgtcccccaaanacgaggggactgcagtggatggatacatctacttnagtacggaaaccccaactaccaaccccctccacgaggacgtccacgtccgaccacttactcccgtagtacctaccgtaccaaaccaacccagacctccacctacgaccgatgacacgtctgtacgacccgngtcgacgaacacgtacgttaccgtttaattaccgtgtcggacgacgtataccgtggaccgtaactcgtaacggttagtaacgttacgttagggtacgttacgggtaaccggtcggtacggggtaccgaaaccgggaccgtacggtacgtaaccgttcgtaccttccgacgaccgtcccacccgaacggaaccgcctaacgtccgtcccctcccgacgtccctaacccc

SEQ ID NO: 342088 - DNA, 718 bp, Homo sapiens
  misc_feature: GZ8MTXP02I4BV9.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggattggttactactggtaggttgggtcccggcacgtcccccaacgacgaggggactgcagtggattggatacatctacttcagtacgggaaccccaactacctaacccctccctacgaggtacgtccgacgttcgaccctactactcccgttacggacctccgtaccaaaccgaaccccagactacctccctacgaccatgacctaactcgtcgtccgaacggtctacggacggaccacgtacgtaccgtttaaacttcgtacgtcggcgtcgaagtcgtgggactacgtctaggtacgtacgttagtaggtacgtggtaccggtcgtacgggggacccgaaacggggtacccgtacccggggttactaaccggtttccgttacccgtccgttacccgaccgtacccccggtaccgttaaaaccccggaaacccgggtccccgtaaaccggttacccgggtttacccccgtttaccccccggtcgggtaccccctttaacccccccgg

SEQ ID NO: 342089 - DNA, 784 bp, Homo sapiens
  misc_feature: GZ8MTXP02I6N20.4.12.B01.1.454.CMB.2.raw
  modified_base (250)..(250): a, c, t, g, unknown or other
  misc_feature (250)..(250): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggccaggactggtgaagccttcggagaccctgtccctcacctgcagtgtctcgtggtgcttcagtggatggttactacgtggagttgggtccgcacgtaccccaanacgagggactgcgaggtggattggatacatgtactcgaggtacggaaccccctaactacccaaccccctccgtacgacggacgtacccgaggtccgaccctaacttacgtccccgtaggtaccttacccggtaacccaaacctaaacccccgacgtaaccttccccgtacccccgtaggaacccgtaagttcggaaaccctaagttcccggttacggtaccgaaccccggtacgttccgggaaccggacctaaccggtaccggtttacccgtttttaaattcccggttgtaccgggccgtaacggtaccgttccggacgggggtaccctacctaaccggtaggtttacgaacctttagggtacgggttaacgtcggggtacgggttcgggaccgggggaacccaaagggggtacccacgggttaccgtacgtttcccggaccttcccgtacgaccgtacccgttacccgaaccggaaccgggttcccaccggtttccccggtccccctcccccggtggtaaccccccttccccg

SEQ ID NO: 342090 - DNA, 610 bp, Homo sapiens
  misc_feature: GZ8MTXP02IS2QH.4.12.B01.1.454.CMB.2.raw
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggacgaccctgtccctccacctgcactgtctcgtggtgcttcatggattggttactacgtggaggtttgggtcccgcacgtacccccaagacgagggactgcagtggatggatacatctacttcgacgtacggaaccccaactaccaacccctcctacgacggcgtaccagtccgacctaacttaccgtccctacggtaacctccgaaccaaacaaccccagacctcctaccctagaaccgtatcgactactccgtcgtacgaaccgcgtcgacggacacgtacgtacgttattacgtgtgcgtacgacgtcgcggactactcgtagtgtactagtcgtagtcggacgttcggtacgggaccgaacggaccacggtacacgttcgtctccgtcacgtccctaccgacgaacgtccacgtcgtccgtccccgtcgacctacccg

SEQ ID NO: 342091 - DNA, 693 bp, Homo sapiens
  misc_feature: GZ8MTXP02JB30J.4.12.B01.1.454.CMB.2.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (525)..(525): a, c, t, g, unknown or other
  misc_feature (525)..(525): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagtaccctgtccctcacctgcactgtctcgtggtgcttcagtggattggttactacgtggaggttgggccgcacgtaccccaanacgagggactgacagtggtatggatacntactactcgacgtacggaaccccaacctacccaacccctcctacgacggtacgtcccaggtccaccatacctcccgtacggacctccgtaccaaacaccccagtactccctaccgtgaccgtatcgactactcgtaccgtacgaccgtacgtcgggaaccgtactacccgtacgtttcccggttttaaattcgtacggtcgtcggtacgtacgtccggtacggacgttacctaggaccggttanaccggtttagacgggttagtcgggtcggttcgggtaacggggacgaaacggggtacccgacggttacgtacgttccgtaccgtaccgtacaccgggtacccctacccgaaccggaacggtcccctaacgttccccggtaccccttccccggcgttacccctaccccgg

SEQ ID NO: 342092 - DNA, 659 bp, Homo sapiens
  misc_feature: GZ8MTXP02JNLD6.4.12.B01.1.454.CMB.2.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggacgtaccctgtcccctcacctgcactgtctcgtggtgcttcatcggattcggttactacgtgggtaggttgggtcccgntacgtccccaanacgagggctgcgagtggatggatactntctactcaggtaccggaacccctaactaacccacccctcctacgaggactaccgacgtaccgccaattacctccgtcggactcccgtaacaaacctaaccccgagtactccgtaccctagaaccgtagtcgactactacgttgcgacccgtgtacggaccggactaccgtacggttactttacttacgtcgtccggacgtacgtacgtcgtacgggcctacgtacggtagtacgtacgttagtaggtaacgtcggtacgggtcggtacggggtacaacggggactaccgggtcgtacgtcgtaccgtccacgtcgacccctacgaccggaacgtcccgtacgtcccgtacccgtcccgtcggaaccctcccg

SEQ ID NO: 342093 - DNA, 666 bp, Homo sapiens
  misc_feature: GZ8MTXP02FJ5GJ.4.12.B01.1.454.CMB.2.raw
  modified_base (183)..(183): a, c, t, g, unknown or other
  misc_feature (183)..(183): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggatcgggcccaggactggtgaagcctttcggagaccctgtccctnacctgcactgtctctggtgcttcatggattggttactactggagttgggtccgnagtccccaancaggactgcagtggattggatacntctacttcagtcggaaccccaatacaacccctctnaggatccagtcgcatatcccnggactgtccaagaaccccagancttccngaccgatgacagtcngtnaccgntgacgacacagacctttatacctgtcgtacgcgtattcgtgggacgtaaccgttacgacggtacgaccgttaagttggtaaagttcgggtaaccgttcggttacgggggacccaaacgggggttaacccaaaccggggttctaaaacgtttaccgttacccggttcccgtttaacaaccgggtacccctttaaccccgaaaaccccgtaaaaacgggggcccccttaaaacggtccccggggtttaacccttttcccccccggtaggggaccctttaaaaccccccgg

SEQ ID NO: 342094 - DNA, 696 bp, Homo sapiens
  misc_feature: GZ8MTXP02JGVHW.4.12.B01.1.454.CMB.2.raw
  modified_base (256)..(256): a, c, t, g, unknown or other
  misc_feature (256)..(256): n is a, c, g, or t
tcagagcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatcggattcggttactacgtggaggttcggggtccgctacgtccccaanacgagggactgcgtagtcggagttggatacatcgtacttcaggtcggaaccccactaccaacccctcctacaggactaccacgtacgccactactcccgtcggacctaccgtaccaaaccaaccccgagtaactccctacccgtagaccgtattcgaactaacttcgtacggtcgaacccgtcgtacggaccgtaacctacgtaccgggtccttttaattacgtgtacgtccgcggtactcggtacggggtacgaacctgtaacggttagacccgttaggtacggtaagtcggggtaccgttcgggtaacgggggaccgtaaacgggggacctcggggtacgtagtcccggttcctacccgtacgtcgtaccccgtaccgaaccggaacgggccccttaacgggtccgttccccgtaccccttcgggacccttacccccg

SEQ ID NO: 342095 - DNA, 540 bp, Homo sapiens
  misc_feature: GZ8MTXP01CJGXW.41.23.C01.1.454.CMB.2.raw
  modified_base (310)..(310): a, c, t, g, unknown or other
  misc_feature (310)..(310): n is a, c, g, or t
  modified_base (467)..(467): a, c, t, g, unknown or other
  misc_feature (467)..(467): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtctatactatcacgaccggtgctcgatttagtacacgtgattagggattgggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagccccagggaggggaatgggagtggattggtgacatccattatactggggcgacgtactactctccgtcctcaagngtcgtctcaccatttcgagggacacgtccatcgaaccccgcttctccctgaaactgaccctcgtcgaccgccgcgacacggccgtttattctgtgcgaggcgagactggtctttcaattctatggggccgtgggggcacccgtggcactgtctctcngtcttccaccaagggcccattcggtcttccccgnggcncccgttgcctccaggcgcacttcgtcggggcaacg

SEQ ID NO: 342096 - DNA, 591 bp, Homo sapiens
  misc_feature: GZ8MTXP01CG8Z4.41.23.C01.1.454.CMB.2.raw
  modified_base (275)..(275): a, c, t, g, unknown or other
  misc_feature (275)..(275): n is a, c, g, or t
  modified_base (444)..(444): a, c, t, g, unknown or other
  misc_feature (444)..(444): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcacgccccgaggggaggggaatgggagtggattggtgacanccattatacgtggggcacgtactactctccgtccctcaagagtcgtctcacctatttcgagggacacgtccatcgaaccccgcttctccctgaaactcgaccctcgtcgacccgccgcggacacggtcctttattctgtgcgaggcgagacttggtctttcaatctagnggggccgtgggccaccgttggtcacgttcgtctcctcgacgtccttcccaccgaacgggcccctagttcccgggtcccttccccgtcgggcccgccccgttcgcccgtcccgaaggccgcccgccgttccggtcgggggccaaccgg

SEQ ID NO: 342097 - DNA, 660 bp, Homo sapiens
  misc_feature: GZ8MTXP01BV5AP.41.23.C01.1.454.CMB.2.raw
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagtttccatcagttctgatctattcgttgggctggactccggcacgccccgaggggagggaagtgggagtggagttggtgacatcctattagtacgtgggacgtaacgtactacctcgtcccgtccctacgaacgtacgtcgtctaccacctagtttcgacggacacgtcatcgaacccncttctcctacaactcgacctccgngacccgcgcgacacgtcgttattcgngtcggcgtaggcgagtacgttggttacttacgaagttcgtaggtcgggggtcccttgggggacccttacccggttggtaccctacgttcgtcctccttaccgacgttccctacccgaaccgaacgggtcccctacgttcccgggttcccttccccgtcgggtccccttcccgttcgacccgtaaccgagggaacccgtcccgtaccggttccgggtcgggggaacccaaccgggg

SEQ ID NO: 342098 - DNA, 610 bp, Homo sapiens
  misc_feature: GZ8MTXP01AMFG6.41.23.C01.1.454.CMB.2.raw
  modified_base (277)..(277): a, c, t, g, unknown or other
  misc_feature (277)..(277): n is a, c, g, or t
  modified_base (498)..(498): a, c, t, g, unknown or other
  misc_feature (498)..(498): n is a, c, g, or t
  modified_base (579)..(579): a, c, t, g, unknown or other
  misc_feature (579)..(579): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggactccggcacgcccccgagggaggggaatgggagtggattggtgacancctattagtacgtggggcgtacgtactactctcccgtcctacagagtcgtctcacctatttcgaggacacgtccatcgaacccgcttctccctagaactcgacctccgtcgacccgccgcggactacggtcgtttacttctgtcgcgacggcgagtacgttcggttacttacgaatcgtagtcgggccgtggggcctaccgtggtcactcgtcctcctcgngtccttccgacccgtaacgggcccctacgttcccggttcccttcccccgtggccccgttcccgttcgcctcccgacggtcncccgtacccgttcggtcgggggccaaccggg

SEQ ID NO: 342099 - DNA, 746 bp, Homo sapiens
  misc_feature: GZ8MTXP01BXW1S.41.23.C01.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagtctatactatcacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttcttcctgtcttcttctgttggagcagcgtcacatcacttgccgggnagtcgtaggttcgttttcggngcttgttgccttaggttacaaacggaaaagggggcgacggcccctaaggtcctcgtctctcgtagaaaccagtacgtagggaaggtacgacggttccccgtacgtaggttcacggtcgcctacggtccgagggtggtcggggccggtaacgtccactccgtccaacccgtaagtttaccgccgaaccgtcgggacccggtacctaggaacgttattcgtacgtactaaacttttacgttctacgttcgtaacgtcgtaagtacttacagttacgttccgttaccccgtttcgttaacgtttttcgggaccgtaaccggggaacccgtaaggtaccgtaaggtaaaaccgttaaccgtaaaaaccggtaaccgtttacggtaacggggtccttacggacccgtaaaccttacggttacccttcggttacccgtttccgttaaacctttcccccgggttccccgtaacctttaacgttcccgttaggttaaacgtttaacgtttaaaccg

SEQ ID NO: 342100 - DNA, 595 bp, Homo sapiens
  misc_feature: GZ8MTXP01D6HAT.41.23.C01.1.454.CMB.2.raw
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
tcagtctatactatcacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngatctattcttggggctggatccggcagcccccgagggacgggaatggagtggattggngacatccattatacgtgggggcgacgtactactctccgtccctcaacgtacgtcgtctacacctaattcgcggactacgtccatcgaaccgtcttctccctagaaactcgacctcgcgtaccgccgcgacgacgtcgttattcgtgtcggcgtggcgagtacgttggttactttcaaacgttcgtaacggtcggggtccgtgggtcctaacccgttgggtacttcgttcggttccttccgttcgacgtccttacccgaaccgaacgggcccacgtcccgttcccgtttcccccgg

SEQ ID NO: 342101 - DNA, 796 bp, Homo sapiens
  misc_feature: GZ8MTXP01D14RF.41.23.C01.1.454.CMB.2.raw
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcgttggggctggatccggcacggccccgagggaggggaagtgggagtggtagttggtgacatacctagttacgtacgtggggacgtacgtactactctcccgtccctcaacgacgtccgtctctaccgtagtttaccggacgggacctaaccggtcctaagtaccgtaaacccccgtcctttaccgtaccctagaaaaccgtccgtaaccctcccgggtacggaaccccggcccggaccgggtaaccgtacccggggttccgtttttaactttccgtggtacggtacgggtacggggtcgtaacggtaccgtttgggttacctttacgaaactttccgtaagggttcgggggtccccgttagggggtaccccttaacccggttcgggttacctaccgtttccggttcccttcccgttacgtaccgtcccgtttaacccgaacccggtaaccgggtccccttaaccgttcccgggtttccccttcccccggtcgggtccccttcccccgttggttaccccgttaacccggacgggtccgtaacccgtcccggttcggggttccgggggaacccgtccggg

SEQ ID NO: 342102 - DNA, 719 bp, Homo sapiens
  misc_feature: GZ8MTXP01DB9HV.41.23.C01.1.454.CMB.2.raw
tcagtctatactatcacgaccggtgctcgatttagtacacgtgattagggattggggcagggtgaacacctgtggttttcctcctgctggtggcagctcccagatgggtcctgtcccaggtgcagctgcaggagtcgggcccaggactggtgaggccttcgggaaccctgtctctcatctgcactgtctctggagttccatcagttctgatcattcgttggggctggatccggcacggcccccgaggggagggaagtggagtggtagttggtgacagtaccattagtacgtgggcgtacgtactactcctcccgtccctacgaagtacgttccgtctccgacctacgtttacggaacgggtacctaccgtaccagtaccgtaaacccccgtcctttaccgtccctaacgtaaacctaccgtaacccgtcccggtacgaccccggcccggaccggacccgtacggttccgtttactttccgtggtcggacgagggcgtaacgtaacgttcgggttacctttacgaacgttcgtaaggtccgggggtcccggtggggcccgtacccgttgggtcctacgttcgtccgtccgtactcgtcccttacccgaaccgtaaccgggtccctacgttcccggttccccttccccggttcggccccgttccccgttcgttaccctcccgaaggccgtcctacccggttcggtcgggggctaacccggg

SEQ ID NO: 342103 - DNA, 669 bp, Homo sapiens
  misc_feature: GZ8MTXP01COTJJ.41.23.C01.1.454.CMB.2.raw
  modified_base (263)..(263): a, c, t, g, unknown or other
  misc_feature (263)..(263): n is a, c, g, or t
  modified_base (636)..(636): a, c, t, g, unknown or other
  misc_feature (636)..(636): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggtagttccatcagttctgattcatttcgttggggctggactccggcacgccccgaggggagggagtgggngtggagttggtgacatcctattagtacgtgggacgtacgtactacctcctcccgtccctacaagtcgtccgtactcctaacctacgtttacggacgggacctacgtacacgtacgaacccccgtcttcctcccgtaacgaacctcgacctccgcgacccgccgcgtaccgcggttcttacttcgtagtcggcgaggcgtagtacgttcggttacttacgacgttcgtacggtcgggtaccgtcggggtacctacccggttcgtaccgtacgtccgtcctccttacgcgtaccctacccgaccgtacgggcccctacgttccccgttcccgttccccggtcggtcccgcccgttcgcccgttccgacggtcccncggtaccgttcgggtaaccgggcgtaacccggg

SEQ ID NO: 342104 - DNA, 616 bp, Homo sapiens
  misc_feature: GZ8MTXP02GZV7M.41.23.C01.1.454.CMB.2.raw
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaaacgaaaaggggagaggcccctaaagggtccctcgtctctcgtagaaaccngactggaaggtagacgtcccgcaggttcagtgccagtccaggtggtggccccggagtccactctcaccattcgcgacctgccggcctagaaagtattctgactaacttattctgtcagcagtatcatagtcgtccccgttctaccgtttggaccgtaggggaacccaaggcctaggaaaactaccgaaaacgtaacgtggttacgcgtacggaccaccctaattccgttcgttaccttttaccgaaacgtttccccttttacccccggaccccttaaagtttcccttacggtaaaacttttaaacg

SEQ ID NO: 342105 - DNA, 669 bp, Homo sapiens
  misc_feature: GZ8MTXP02F9ANN.41.23.C01.1.454.CMB.2.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagtctatactatcacgaccggtgctcgatttagtacacgtgattagggattgggggtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgccttggttacaaacgaaaagggggnacggcccctaaggtcctcgtctctcgtagaaaccagacgtggaaggtagacgtcccgtccaggttcagtcgccagtccaggtggtgggccgagtccactcncacattagcgactgcggcctgaagtnttctgactaaactttatttctgttcaagctaagtatcatagttccgtcccccgtttctaaccgtttttcgggacccgtaacgggggaaccctaaacggtccgtaagggaaaacttaccgaaaaaccggtaaaccgttggtacgggaccgttacggacctaaccccgtaaagtttcccttcggttaacccgtttcctaaaccgtttccccgttttacccccccggacccttaaaccgttccctttacggaaacctttaaacgtttaaaacc

SEQ ID NO: 342106 - DNA, 664 bp, Homo sapiens
  misc_feature: GZ8MTXP02IOTYR.41.23.C01.1.454.CMB.2.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
tcagtctatactatcacgaccggtgctcgatttagtacacgtgattagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggngcttgtgccttggttcaaacgaaaaggggnacggcccctaaggtcctcgtctctcgtacgaaaccagactgggaaggtagacgtccccgtcaggttcagtcgccagtccgagggtggtcggggccccggagtcccacgtctacacctagttcgccgtaccgtcggccggcctaggaaacgtactttcctagacctaaacttttactttcgtcgttaccaaggtcctaaaggttactaccgaatttacggttaccgttccccccggtttatttaccggtttttcgggacccgtaagggggtaacccaaagggtccgtaagggtaaaacttaccgaaaaacggtaacttgggtacggtacctaggaccctaaccgacttccgtagttccttcaacgttccttcccgctacttcgtactattaacg

SEQ ID NO: 342107 - DNA, 581 bp, Homo sapiens
  misc_feature: GZ8MTXP02J3BBO.41.23.C01.1.454.CMB.2.raw
  modified_base (312)..(312): a, c, t, g, unknown or other
  misc_feature (312)..(312): n is a, c, g, or t
  modified_base (442)..(442): a, c, t, g, unknown or other
  misc_feature (442)..(442): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (579)..(579): a, c, t, g, unknown or other
  misc_feature (579)..(579): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggcctttcgggaaccctgtctctcatctgcactgtctctgagtttccatcagttctgatcattcgttgggctggactccggcacgccccgagggagggaatggagtggattggtgacagtcctattatacgtgggcacgtactactctcccgtccctnaagtacgtcgtctacacctagtttcggacgggaccacgtaccatacgaaccccgtcttcctccctagaactcgacctccgtcgacccgccgcgaccgtacggttcctttattcgtagtgacggaggcganacgttgttcttacaacttcgtagtcggggctcgggctaccgtgtcctactcgtccttccacacgtcctaccgaaccgtacggccctacgtccgtccctcccgtcgcccgacctcgccncgaggccncgcgcgcggcncg

SEQ ID NO: 342108 - DNA, 767 bp, Homo sapiens
  misc_feature: GZ8MTXP02IL6QE.41.23.C01.1.454.CMB.2.raw
tcagtctatactatcacgaccggtgctcgatttagtacacgtgattagggattgggggctttctgagagtcaaggacctcctgtgcaagaacatgaagcacctgtggtttttcctcctgctggtggcagctccagatgggtcctgtcccaggtgcagctgcaggagtcgggcccaggactggtgaggccttcggaaccctgtctctcatctgcactgtctctggatttccatctagttctgatctattcgttggggctggactccggcacgccccgagggagggaatggagtggattggtgacatccattatacgtgggacgtacgtactactctccgtcctacaacgtagtccgtctcctaacctacgtttacggacgggtaacctaaccgtacctaacgtaccgtaaacccgtcctttaccctaccccgtaacgtaaaacccttccgtaaaccccgttcccggttacccgaacccccggtcccggaacccgggtaacccgtaaacccggggttcccgtttttaaacgttttccggttcggttacgggtaccggttaacggggaccggtaacgggttaaaccgtttcggggtttacccttttaaccgtaaaacgtttccgttaaacgggttccgggggtacccgtcgggtaacccgtaccccggtttcgggtaccctacgttcggttcccgttcctccgtacgtccctttacccgaacccgttaaaccggggcccctaacgttcccgggtttcccctttcccccgg

SEQ ID NO: 342109 - DNA, 729 bp, Homo sapiens
  misc_feature: GZ8MTXP02F2CQJ.41.23.C01.1.454.CMB.2.raw
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
tcagtctatactatcacgaccggtgctcgatttagtacacgtgattagggattgggggctttctgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggatttccatcagttcngatcattcttggggactggatccggcacgccccgagggacgggaatggagtggagttggnganagtccattagtacgtggggacgacgtactacgttctcccgtcctcaacgtagtccgtactcacctactttcggagggtaccacgtccagtcgtaaacccgtcttccctacctacgtaaacctcgaaccctccgtcgaccccgccgaccgggaccgtaccgggtaccgtttaacgttttcgcggttaggaccgaggggtaccgtaaaggacccgtttgggttaccgttttaactaaaacgttccgttaacgggttcggggggtccccgtttaacgggacccgttaccccgttacgggggttacccttacggttaccgttcccggtttaacccgtccttaaaccggtccctttaacccccgaaaaccgttaaacccgggggaaccccctacggtttacccccggggtttacccctttcccccccggg

SEQ ID NO: 342110 - DNA, 591 bp, Homo sapiens
  misc_feature: GZ8MTXP02FLCOW.41.23.C01.1.454.CMB.2.raw
  modified_base (333)..(333): a, c, t, g, unknown or other
  misc_feature (333)..(333): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttgggctggatccggcacgccccagggagggaatggagtggattggtgacatccattatacgtgggcgacgtactactctccgtcctcaagagtcgtctcacctattcgaggacncgtcatcgaccccgtcttcctcctagaaactgaccctcgtcgaccgccgcgacacggtcctttattcgtgtgcgaggcgagtacgtggtctttcaatctagtcggggccgtggccctaccgtgggtacctacgtcgtctcctcgtacgccttaccgaccgtaacgggccctagtcccggttcccgttcccccgtcggcccgtccccgtcggtccccttccgacggtaccgcccgacccgtcgggtcggggaccaccgg

SEQ ID NO: 342111 - DNA, 680 bp, Homo sapiens
  misc_feature: GZ8MTXP02IC2SM.41.23.C01.1.454.CMB.2.raw
  modified_base (613)..(613): a, c, t, g, unknown or other
  misc_feature (613)..(613): n is a, c, g, or t
  modified_base (676)..(676): a, c, t, g, unknown or other
  misc_feature (676)..(676): n is a, c, g, or t
tcagtctatactatcacgaccggtgctcgatttagtacacgtgattagggattggggcagggtgaacacctgtggttttttcctcctgctggtggcagctcccagatgggtcctgtcccaggtgcagctgcaggagtcgggcccaggactggtgaggccttcgggaacctgtctctcatctgcactgtctctggtagtttccatcagttctgatctatttcgttgggctggacgtccggcgacgcccccgagggacggggaagtgggaggtggtagttggtgacagtccattagtacgtgggcgtacgtactactcctccgtccctcaagtacgtcgtctcacctagttacggaggacacgtaccagtacgaacccctccttcctccctagaaactcgacccgtccgtaccgacccgcccggaccggtaccgtaccggtccgttttacttcgtcggcgtcggacggtcggtagtacgttcggttacctttacaagttcgttacggtcgggggtcccgtggtccctaccggttggttcctacgttcgtccttcctcgaccgttccttaccgaaccgtaacgggtcccctaggttcccggtccctttcccccggnggtccccgacccgttcgcccgttcccggaacggcctaccgcccggttcggccgggggtacccnccgg

SEQ ID NO: 342112 - DNA, 706 bp, Homo sapiens
  misc_feature: GZ8MTXP02IHOUJ.41.23.C01.1.454.CMB.2.raw
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (318)..(318): a, c, t, g, unknown or other
  misc_feature (318)..(318): n is a, c, g, or t
tcagtctatactatcacgaccggtgctcgatttagtacacgtgattagggattgggggagtcagaccctgtcaggggacagcatggacatgagggtcccgctcagctcctggggctcctgctgctctggctcccaggttcagatgtgacatcgagatgacccagtctccttccttcctgtcttcttctgttggaggcagcgtcaccatcacttgccggcgagtcgaggttcgttttcggngtcttgttgccgttggtttacaaacggtaaaaaggggnacggtcccctaaaggtcctcgtctcgtcgtagaaacccgngtacgtgggaaacggtacgacgttccccgtactaggttcaagttcgcctaggtccagggtggcgggccccggagtccacgtctcaccattcgcgactggaccggtcctagaacgtacttcctagtccttaaactttacgttcgtcgttacagtctaagttactaccgagttaacggtccgtacccgtttcgttaaccgttttcgggaacccggtaacgggggaacctaacggtcgttaacgaaaacgttacgaaaaccggtaacgtggttacggtaccgtcggacctaaaaccgtactttccggttaactttccggtttaacctaacgttttcccccttaccccggtaaccctaagtttacccgttaacgtttaaacgtttaaaaccg

SEQ ID NO: 342113 - DNA, 644 bp, Homo sapiens
  misc_feature: GZ8MTXP02I5HBN.41.23.C01.1.454.CMB.2.raw
  modified_base (429)..(429): a, c, t, g, unknown or other
  misc_feature (429)..(429): n is a, c, g, or t
tcagtctatactatcacgaccggtgctcgatttagtacacgtgattagggattggggcagggtgaacacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatctattcttggggctggatccggcacgccccgagggagggaagtgggaggtggagttggtgacatccattatacgtggggacgacgtactactctccgtcctcaagacgtcgtctcacctagtttcgaggacacgtccatcgaaccccgtcttcctacctacgaaactccgtaccctccgtcgacccgccgccgaccgacggttccgtttatttcgngttcgcgaggcgtagtactcggttctttacaatcgtagtcggggccgtggcctaccgtcggtcaccgttcgtccttacctcgtacgtcccttacccgaaccgtaaccgggtaccctacggttcccggttccccttcccccggttcggccccgtccccgtacgtaccctccggaacgggacgtcccgtaccggtcgggtcgggggaccaacccggg

SEQ ID NO: 342114 - DNA, 911 bp, Homo sapiens
  misc_feature: GZ8MTXP01CUV7Y.8.19.B08.1.454.CMB.2.raw
  modified_base (281)..(281): a, c, t, g, unknown or other
  misc_feature (281)..(281): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccaggcctgggagtccctgagactctcctgtgcaggctctggattcaccttcagtaactacggcgngcacgtcgggtcccgccgaggcctccgaggaccgaagggggtcctttaggggacggtgggtcttaggggcctagggttttcgtttccgagtttccgtaaggggtaaaggtaacgtttaggtttaccaaaagttacttaaagtaacccgtaaacggtacccgtcccgggttacgggaaaccgggggtcccgtaatttaccgaaccctaaagttccccgttaacccgaaggtaaaccggaaactaaaacgtttacccgaaaaacggtaaaccgtaaacggtaaagttacggttaaacgttaccgttaacggttaaaccgaaaaacggtttccggggggaaaacccaacggggttaaaccccgttaaaaggggtaccggtttaaacggggaaaccgggttaaacccggtaaaccggggttaccgttttaagggtttttaaacgtttaaaccgggttaaggggttaaaaaccggggaaaacggggggttaaaggggggggtaaacttaaacgggtaacgggggttcggaaccgttaacggggttacccttaaacccggtaaaacggttttaaccggtttaacgttttaccgggttaaccgggtttaaccggttcccggggggtaaaccccgggg

SEQ ID NO: 342115 - DNA, 584 bp, Homo sapiens
  misc_feature: GZ8MTXP02JQ5I4.8.19.B08.1.454.CMB.2.raw
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
tcagctcgcgtgtccacgaccggtgctcgatttagtgagtcagtaagggggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggctggtccagcctgggagtccctgagactctcctgtgcaggctctggattcaccttnagtaactacggcgtgcacgtcgggtcccnccaggcctccgaggcaaggggcttggagtggctggctagtttgtttcatcgtagaaggtagtcgttacaatactatacagacctcgtagaaggccattcaccatcctaccagagacaattaccaagaacacgatacgtatctagacaaatggacagactaaggagtacgaggacacgtcttagtttactacgtaggtaacggaaagggtagggggaactacgtaggtaggacgagtccgtaacgtaaacgttacttaacgtttcgtaacgtttcggtacggggtaacccgg

SEQ ID NO: 342116 - DNA, 540 bp, Homo sapiens
  misc_feature: GZ8MTXP01BEZ5P.3.34.D01.1.454.CMB.2.raw
  modified_base (513)..(513): a, c, t, g, unknown or other
  misc_feature (513)..(513): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattatgtgcgagagagagaacattaaattggcggctactagagaacggattgggcgccgtgggggccaaaggggaccacgggtcagtcgtctcgcagcctccaccaagggcccatcggtcttcccctgcacccctcctccaagcgcacctcgtgggggcacgcgccggccctgggctgccttgggtcaaggctacttccgngttgcgtctcgtgagcgggtcttggcg

SEQ ID NO: 342117 - DNA, 559 bp, Homo sapiens
  misc_feature: GZ8MTXP01DMHMS.3.34.D01.1.454.CMB.2.raw
  modified_base (480)..(480): a, c, t, g, unknown or other
  misc_feature (480)..(480): n is a, c, g, or t
  modified_base (529)..(529): a, c, t, g, unknown or other
  misc_feature (529)..(529): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctagcagacgccgtgaaggggcggtgaccatctccagagacaattacaagaacatgctgtatctgcgattgaacaacgtcagagccgacgacacggcccactattatgtgcgagagagagaacattaaattggcggctactacgagaacggattggggcgcccgtgggggacccaaaggggacccaacgggtcagtcgtctccgcacgcctccaccaacgggcccatccggtccttccccctcggccacccctcctccaagcgccacctcgngggggcacacgccggccctgggctgccttggtcaagggctacgttccgngttcgcgtctcgtgagcgggcgttggaacg

SEQ ID NO: 342118 - DNA, 560 bp, Homo sapiens
  misc_feature: GZ8MTXP01AZ39O.3.34.D01.1.454.CMB.2.raw
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattatgtgcgagagagagaacattaaagttggcggcctactagagaacggattgggacgccgtggggccaaaggggacccacgggtcatcgtctccgcacgcctccaccaacgggcccacgtccggtccttccccctggccaccccgtcctcccaagacgccacctcgtcggggcacgacgccggcccgtcgggctcgccgttggtcaaggactacttcgcgttgcgtctcgtgacgcgggcttggaacg

SEQ ID NO: 342119 - DNA, 558 bp, Homo sapiens
  misc_feature: GZ8MTXP01BQWUF.3.34.D01.1.454.CMB.2.raw
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattatgtgcgagagagagaacattaaatttggcgggctacgtacgagaacggattgggccgccgtgggggcccaaaggggacccaacgggtcaagtccgtctccgcacgccctcaccacggcccatcggtccttcccctggccaccctcctccaacgacgcacctcgtcggggggcacgacgcacgcccgtggctgccgtggtcaacggctaacgttccgagtcgcgtcgtcgttgcggcgggcgtgggcaagggcgacngttaagng

SEQ ID NO: 342120 - DNA, 541 bp, Homo sapiens
  misc_feature: GZ8MTXP01DR8UT.3.34.D01.1.454.CMB.2.raw
  modified_base (514)..(514): a, c, t, g, unknown or other
  misc_feature (514)..(514): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcggctactacgagaacgattgggcgccgtggggcccaaagggaccacggtcatcgtctccgcagcctcaccaagggcccatcggtctcccctggccaccctcctccaagacgccacctcgtcgggggcacgacgccggccctggggctgccttggtccaagctacttccgngttcgcgtctctgagcggcttggaacg

SEQ ID NO: 342121 - DNA, 558 bp, Homo sapiens
  misc_feature: GZ8MTXP01BUZJU.3.34.D01.1.454.CMB.2.raw
  modified_base (515)..(515): a, c, t, g, unknown or other
  misc_feature (515)..(515): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaattggcgggctactacgagaacggattgggccgccgtggggacccaaggggacccaacgggtcaagtcgtctccgcagccctccaccacggcccactccggtccttccccctggcccacccctccctaccaacgcgccaccgtcgtcggggggggcacgacgccggcccgtgggctgcctggtcaaggctcgttccgngttcgcgttctcgtgcgcgggcgtggcgaaggcgcataagngn

SEQ ID NO: 342122 - DNA, 605 bp, Homo sapiens
  misc_feature: GZ8MTXP01AFNXL.3.34.D01.1.454.CMB.2.raw
  modified_base (348)..(348): a, c, t, g, unknown or other
  misc_feature (348)..(348): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaattggcggctactacgagaacggattgggccnccgtggggccaaaggggccaacgggtcaagtcgtctccgcacgccctccaccgaacgggcccacgtccggtccttcccccgtggcccacccctccctcccaacgacgccacctcggtcggggggggcaccgacggccggcccgtcggggcctcggcccgtcgggtaccgaaacgggtaccttaccgttccggaaggttcggccgttccgtcgtcggacggttccggggcgtgggcgaacgggccgcgagtaaggngn

SEQ ID NO: 342123 - DNA, 578 bp, Homo sapiens
  misc_feature: GZ8MTXP01A3G1L.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattatgtgcgagagagagaacattaaattggcggctactacgagaacggattgggcgccgtggggccaaggggaccacgggtcatcgtctccgcacgcctccaccgaacgggcccacgtccggtccttcccccgtcggccacccctcctcccaacgacgccacctccgtcgggggcaccgacggccggcccgttcggggcctcggccgttgggtccgaacggacctaacttccgcgttcgcgtctcgtgacgcgggcgttcgggaacg

SEQ ID NO: 342124 - DNA, 617 bp, Homo sapiens
  misc_feature: GZ8MTXP01CRZX9.3.34.D01.1.454.CMB.2.raw
  modified_base (263)..(263): a, c, t, g, unknown or other
  misc_feature (263)..(263): n is a, c, g, or t
tcagagacgcactccacgaccggtgctcgatttagatcgtctgtgttgggtttggggagacctggttgagcctgggggtccctgagactcgcctgcgcaccttctggattcaccgtcagtagcagctacatgcactgggtccgccaggctccagggaaggggctggagtgggtctcagttatttacaattctggtaccacatactactccgaccccgtgaagggccattaaccatctccagagacgattccgagaacacggtntatcttacaaatgaaacaacctgagagccgacgacacggtccgtttattactgtgcgagagatttcgagtgggttcgggaccctcacccgttggttctacttcgatccctcgtggggccgtggccaacccttgggtcactgtcctcctcacgccctccaccaacgggccccagttccggtcccttcccccgtggcccgtccctgccctccgagggacgcccaccgtccgagacgccaacgcgcccggcccttgggggccttggccccgtgggtaccgaaacgggtccttaccgttcccggaggttcgccgttcgttcgttcggaacgggcggcgtcgggcgaacgggcgcgaag

SEQ ID NO: 342125 - DNA, 789 bp, Homo sapiens
  misc_feature: GZ8MTXP01CYLK6.3.34.D01.1.454.CMB.2.raw
tcagagacgcactccacgaccggtgctcgatttagatcgtctgtgttgggtttgggggagacctggttgagccgtggggggtccctgagactcgcctgcgcaccttctggattcacctttagtacatatgtcatgacctgggtacgccaggctccgagggaaggggctggagtgggtcgcaagtataaacggtcgtgctgataagacagcctacgcagacgccgtggaagggcggtgaccatctcagagacaattacaagaacatgctgtatctgacgattagaaacaacgtcagacgccgaacgacaccggcccactattatgtgacgagagagaagaactaagtttaaagttgggacggtacccttaacgtaacggaaggtaaacggtaggttacgggggccgtcccgggtacgggggaacccgaaacgggggacccctaacggggtccaacgttcccggtccctacccggccaaccgcccctacccgaacccgaaccggggcccctagttccccgggttccccttccccccgtcggacccctacccccttacccgtaccccgaaacggaccgtaccccgtaacccggttccgggaccggggggacccaaaccggacccgggtccccggggtcccccggtcgggggtcccgttccgggtccccggttacggggttaaccgaaaccggggttaaccctttacccggttaccccgggttagggttccgggtcccgttccgttccggttcggggaccggggttccgggggtccgttaacggggaaccggg

SEQ ID NO: 342126 - DNA, 541 bp, Homo sapiens
  misc_feature: GZ8MTXP01CH1P8.3.34.D01.1.454.CMB.2.raw
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattattgtgcgagagagagaacattaaatttggcgggctacgtagagaaacggnttggggccnccgtgggggccaaaggggacccaacgggttcaatcgtctccgcacgcctcaccaaggcccatcggtcttcccctgcaccctcctccaagacgcacctcgtcggggggcacgacgcggccctgggcctgccctggtccaaggctcttccgagttgcgttcgtcgtgagcgggctggccaaggcgcatgngn

SEQ ID NO: 342127 - DNA, 593 bp, Homo sapiens
  misc_feature: GZ8MTXP01A80Z8.3.34.D01.1.454.CMB.2.raw
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctagcagacgccgtgaaggggcgggtgaccatctccagagacaattacaagaacatgctgtatctgcgattgaacaacgtcagagccgacgacacggcccatatatgngcgagagagagaactattaaattggcggctactagagaacgnttgggcgcgtggggaccaagggccaggtcatcgtctcgcacgcctccacaacgggcccatccggtcttccccgtggccaccctcctccaagacgccaccgtccgtgggggccacgacgccggcccgtcggggcctcggcccgttcgggaccgttaaacgggtacctaacccgttcccggacgttcggtccggttccgttccgtcggacgggccggggtaaccgttcgggggaacccg

SEQ ID NO: 342128 - DNA, 587 bp, Homo sapiens
  misc_feature: GZ8MTXP01ELXF9.3.34.D01.1.454.CMB.2.raw
  modified_base (308)..(308): a, c, t, g, unknown or other
  misc_feature (308)..(308): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcaagagccgacgacacggcccactattatgtgcgagagaganaactattaaagtttggcgggctaacgtacgagaacggattggggccgccggtaggggccaaaggggacccaacgggtcaacgtcgtctcccgcacggccctaccgaccacgggcccacgtccggtccttccccctcggacccaccctccctaccaagacgcaccgtcgtcgggggggcacgacgccggcccgtggctcgccgtcggtccaaggtccgtaactccggtagttcgcgttcgtccgtgacggcgggcgtggcgaacggcggacagtaagngn

SEQ ID NO: 342129 - DNA, 609 bp, Homo sapiens
  misc_feature: GZ8MTXP01DOB6L.3.34.D01.1.454.CMB.2.raw
  modified_base (145)..(145): a, c, t, g, unknown or other
  misc_feature (145)..(145): n is a, c, g, or t
  modified_base (396)..(396): a, c, t, g, unknown or other
  misc_feature (396)..(396): n is a, c, g, or t
  modified_base (576)..(576): a, c, t, g, unknown or other
  misc_feature (576)..(576): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacnccaggctccgagggaaggggctggagtgggtcgcaagtataaacggtcgtgctgataagacagcctacgcagacgccgtggaaggggcgggtgaccatctccagagacaattacaagaacatgctgtatctgcgaattagaaacaacgtcagacgccgacgacaccggcccactattagtgtgacgagagaagaagaactaatttaaagttggcggtactacgtaacgaaggaacgtagtgggccgccggnggggacccgaaagggaccacgggtcacgtcgtcctcgcacgcctccaccgaacggccacgtccggtccttcccctcgccctaccctcccgtaccaacgacgccgaccgtcggtcgggaccacgacggcccggccccgtgggcccgtcgccgttcggtacgaaacggacttaccgttccgngttcgcgtctcgtgagggcggtcgttcggaacg

SEQ ID NO: 342130 - DNA, 605 bp, Homo sapiens
  misc_feature: GZ8MTXP01E0LAC.3.34.D01.1.454.CMB.2.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagagacgcactccacgaccggtgctcgatttagatcgtctgtgttgggtttggggagacctggttgagcctggggggtccctgagactcgcctgcgcaccttctggattcacctttagtacatatgtcatgacctgggtacgccaggctccgagggaagggctggagtgggtcgcaagtataaacggtcgtgctgataagacagcctagcagacgccgtgaagggcggtgaccatctccagagacaattacaagacatgctgtatctgcgattgaacaacgtcagagccgacgacacggccccatatatgngcgaganagagaactattaaagttggcggcctacgtacgagaacggnttgggcgccgtggggccagggtccacggtcanacgtctccgcacgcccnccacccgaacggccacgtccgttcccgttcccccgtcggcccacccctcccgccaacgacgaccaccctccgggtcgggggcacgacggcccggcccggtcgggcgtcgtcccgttcggtacgaaacgggaacccgtttcccgttccggttacggtcggtccgtccgttcgtcggacgggtccgggttcggtcggg

SEQ ID NO: 342131 - DNA, 578 bp, Homo sapiens
  misc_feature: GZ8MTXP01C9U9Q.3.34.D01.1.454.CMB.2.raw
  modified_base (240)..(240): a, c, t, g, unknown or other
  misc_feature (240)..(240): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgcgtgaaggggcggtgaccatcnccagagacaattacaagaacatgctgtatctgcgattagaacaacgtcagagccgacgacacggccactatatgtgacgagagagagaactattaaattggcggtacctacgtacgagaacggtagttcgggcgccgtggggaccaaaggggaccacggtcatccgtctccgcacgcctccaaccgaacgggcccagtccggtcccttcccctcggccacccctccgtaccgaaagaccgcaccgtcgcgggggaccacgacggccggccgtcgggctcggccgttggtacgaggtactacgttcgngttcgctntcgtgacggcggtcgttggaacg

SEQ ID NO: 342132 - DNA, 564 bp, Homo sapiens
  misc_feature: GZ8MTXP01ALBFJ.3.34.D01.1.454.CMB.2.raw
  modified_base (319)..(319): a, c, t, g, unknown or other
  misc_feature (319)..(319): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattatgngcgagagagagaacattaaattggcggctactagagaacggattgggcgccgtggggcccaaaggggccacgggtcatccgtctccgcacgccctccacccaacgggcccatccggtccttccccctggcctacccctcctccaacgacgccacccgtcgcgggggccacgacgtccggcccgtcgggcctcggccttggtcaacggtctacgttccgagttcgcgtctctgnggcggtcgngcg

SEQ ID NO: 342133 - DNA, 692 bp, Homo sapiens
  misc_feature: GZ8MTXP01A4733.3.34.D01.1.454.CMB.2.raw
  modified_base (288)..(288): a, c, t, g, unknown or other
  misc_feature (288)..(288): n is a, c, g, or t
  modified_base (648)..(648): a, c, t, g, unknown or other
  misc_feature (648)..(648): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctccagagacaattacaagacatgctgtatctgcgattgaacacgtnagacgccgacgacacggcccactattatgtgcgagagagagaactattaaagtttggcggtacctaacgtacggaaggtaaaccgggtagttcgggggaccgcccggtaggggggaccccgaaaggggggacccctacggggttccaacgttcccgtccgttcccggacacgcccctacccgaaccgaaccggggtaccccctacgttcccgggttcccgttccccccgtacgggcccctaccccctacccgtacccaaacgtccgaccgacccgtccggtcgggggccaccgacggcccgggcccgtcggggcctcggtccgttacgggtaccgaaacggtaccttacccgtttccggngttcggtccgttccgtcgtaggcggccggggtcgttgggaaccg

SEQ ID NO: 342134 - DNA, 668 bp, Homo sapiens
  misc_feature: GZ8MTXP01CLO9D.3.34.D01.1.454.CMB.2.raw
  modified_base (306)..(306): a, c, t, g, unknown or other
  misc_feature (306)..(306): n is a, c, g, or t
  modified_base (647)..(647): a, c, t, g, unknown or other
  misc_feature (647)..(647): n is a, c, g, or t
  modified_base (658)..(658): a, c, t, g, unknown or other
  misc_feature (658)..(658): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctcagagaacaattaacaaagaacatgctgtatctgcgtattagaaacaacgtcaagacgaccgacgacacggacccaatatatgngcgagagaagaagaaactaagtttaaagttgggacgggtactaacgtaacggaagaaacggtagttcgggggaccccgccggtagggggacccaaaggggaccctaacgggttcaacgtccgtcgtcccggcacgcccctaccgaaaccgaacgggccctagtcccgggttcccttccccccgtcggacccctacccctccctaccgaaacgccgtacccaacccgttcgggacggggggggaccaaccggcggcccgggtccccgtgggccctacggcccgtggtaaccaacggtaccttacgttcccgagttcgccgttcgtccgtgacggcgggttcngggcaaggccngttagtgngn

SEQ ID NO: 342135 - DNA, 600 bp, Homo sapiens
  misc_feature: GZ8MTXP01A0OWQ.3.34.D01.1.454.CMB.2.raw
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattatgtgcgagagagagaactattaaagtttggcgggctaacgtacgaagaacggattggggcccgccgtggggacccaaaggggaccaacgggtcaagtccgtctccgcacgccctccaaccgacgggcccacgtccggtccttcccccgtcggcccacccctcctacccaacgacgccaccgtcgtcgggggggcacgacggccggcccgtcgggcctcgccgtcggtcgaacggtacctaccgtccgacgttcgtccgttcgtcgtggacggttccgggcgtcgggcgaacgggcgacgagtaagngn

SEQ ID NO: 342136 - DNA, 587 bp, Homo sapiens
  misc_feature: GZ8MTXP01DZTKB.3.34.D01.1.454.CMB.2.raw
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (586)..(586): a, c, t, g, unknown or other
  misc_feature (586)..(586): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgagtcgcaagtataaacggtcgtgctgataagacagcctacgcagacgccgtgaagggcggtgaccatctccagagacaattacaagaacatgctgtatctgcgattgaacaacgtcagagccgacgacacggcccactattatgtgcgagagagagaactattaaatttggacggctaatacgagaacggattcggggcncgtggggaccaaaggggtacccagggtcatcgtccnccgcacgcctaccaccgacggccacgtccgtcccttccccgtcgccctaccctccaccgaacgacgtaccgaccgtcggggcggggacaccgacggccggcccgtcggccgtacgccgtacggtaccgaaacggtaccttaaccgtccggagtcgcgtcgtcgttggcggcgggcgtcggaacgacggcgacgtaagttgng

SEQ ID NO: 342137 - DNA, 597 bp, Homo sapiens
  misc_feature: GZ8MTXP01BJM2M.3.34.D01.1.454.CMB.2.raw
  modified_base (297)..(297): a, c, t, g, unknown or other
  misc_feature (297)..(297): n is a, c, g, or t
  modified_base (597)..(597): a, c, t, g, unknown or other
  misc_feature (597)..(597): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgagtcgcaagtataaacggtcgtgctgataagacagcctacgcagacgccgtggaaggggcggtgaccatctccagagacaattacaagaacatgctgtatctgcgattgaaacaacgtcagagccgacgacacggcccatattatgngcgagagagagaaactatttaaagttgggacggctacgtacgagaaacggtattcggggccgcgtgggggacccaaaggggaacccacgggtcagtccgtctcccgcacggccctacccaccgaacgggccccagtcccggtccttcccccgtggccctaacccgtcctaccaagcgccacccgtcggggtcgggggccacgacggccggcccgtgggcctcggcctgggtacaacggcctaacgttccgaggtcgcgtctcgttggcggccgggcgtggaaccgagggcgacaagttgn

SEQ ID NO: 342138 - DNA, 630 bp, Homo sapiens
  misc_feature: GZ8MTXP01BWZN0.3.34.D01.1.454.CMB.2.raw
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccgaggggaagggctggagtgggtcgcaagtataaacggtcgtgctgataagacagcctacgcagacgccgtggaaggggcggtgaccatctccagagacaattacaagaacatgctagtatctgcgattagaacaacgtnagagccgacgacacggcccatattatgngcgagagagagaactattaaagttggcggtactacgtagagaacgtagtgggcgccggtgggaccgaagggacccaggtcagtccgtctccgcacgccctaccgaccgaacgggcccacgtccggttccttccccgtcggacccacccctcccgtaccgaacggaccgtaccgtacccgtcggtcgggggaccacgacggcccggcccggtcgggccgtcggtccggttcggtaccgaacggtacccgttacgttccggttacgttcggtccgtcgttcgttcgggcggccgggtcgttcgggaaccgg

SEQ ID NO: 342139 - DNA, 604 bp, Homo sapiens
  misc_feature: GZ8MTXP01A823A.3.34.D01.1.454.CMB.2.raw
  modified_base (287)..(287): a, c, t, g, unknown or other
  misc_feature (287)..(287): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagacatgctgtatctgcgattgaacaacgtnagagccgacgacacggcccatattatgtgcgagagagagaactattaaagttggcggtactacgtacgagaacgagttcgggcgccgtggggaccaaacgggaccacgggtcagtccgtactccgcacgccctaccgaccgaacgggcccctagtcccgggtcccttcccccgtcggacctaccccgtcctacccgaagacgcccaccgtcgtcgggggccacgacgtccgggcccgtgggcctcgccgttgggtacaacgggtaccttaccgttcccgagttcgccgtcgtccgtggaggccgggcttcgggaacg

SEQ ID NO: 342140 - DNA, 587 bp, Homo sapiens
  misc_feature: GZ8MTXP01BUZIT.3.34.D01.1.454.CMB.2.raw
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctagcagacgccgtgaagggcggtgaccatctccagagacaattacaagaacatgctgtatctgcgattgaacaacgccagagccgacgacacggcccactattattgtgcgagagagagaacatttaaatttggcgggtctacgtacgagaacggagttcggggcccgccgtggggaccaaggggacccaacgggtcaagtcgtactccgcagccctccacccgaagggcccagtccggtccgttcccccgtcggacccaccccttccctacccgaaacgacgccgaacctccgtcggggggggcacgacgccgggccctcgggctcgccgtgtcaacggctacgtccgtagttcgccgttcgtcgtgacggcgggcgtgggcgaaggcgcagtaagngn

SEQ ID NO: 342141 - DNA, 660 bp, Homo sapiens
  misc_feature: GZ8MTXP01BR5BF.3.34.D01.1.454.CMB.2.raw
  modified_base (659)..(659): a, c, t, g, unknown or other
  misc_feature (659)..(659): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattatgtgcgagagagagaacattaaatttggcgggctactacgagaacggattgggccgccgtgggggcccaaaggggacccaaacgggtcaagtccgtacgtcccgcacgccctacccacccgaaacggggcccaagtcccggtccctttcccccctcgggtcccaccccttccctacccaaacgacgccaacctccgtacgggggggggcaccgacggcccgggccccttcggggccgttcggcccgttggggtaccgaaacggggtaccctaccgtttccccggtaaggttcggcccggttccttccgttcgggaacggccgggggccgttcggggaccgaaacggggccggaccgacgtaagcgng

SEQ ID NO: 342142 - DNA, 618 bp, Homo sapiens
  misc_feature: GZ8MTXP01AD89N.3.34.D01.1.454.CMB.2.raw
  modified_base (271)..(271): a, c, t, g, unknown or other
  misc_feature (271)..(271): n is a, c, g, or t
  modified_base (521)..(521): a, c, t, g, unknown or other
  misc_feature (521)..(521): n is a, c, g, or t
tcagagacgcactccacgaccggtgctcgatttagatcgtctgtgttgggtttgggggagacctggttgagcctggggggtccctgagactcgcctgcgcaccttctggattcacctttagtgcatatgtcatgacctgggtacgccaggctccagggaagggctggagtgggtcgcaagtataaacggtcgtgctgataagacagcctacgcagacgccgtgaagggcggtgaccatctccagagacaattacaagaacatgctgtatcngcatgaacacgtcagagccgacgacaccggcccactattatgtgacgagagagagaactattaaagtttggccggtactacgtacgaagaacggaattggggccgccgtcgggggaccaaaggggacccacggtcatccggtctccgcgacgcctacccgaacccgaacgggccctaacgtccggtcccttcccccgtcgggcccaacccccgtctacccgaacgacgtaccacccgtcgtcgggggacncgtacggccggcccgtcgggcctcggcccgtcggcgtaaacggtaccttacgttccggacgttcggcctcgtcgtcgagggccgggttcgaaccggg

SEQ ID NO: 342143 - DNA, 726 bp, Homo sapiens
  misc_feature: GZ8MTXP01CZCZA.3.34.D01.1.454.CMB.2.raw
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (694)..(694): a, c, t, g, unknown or other
  misc_feature (694)..(694): n is a, c, g, or t
  modified_base (724)..(724): a, c, t, g, unknown or other
  misc_feature (724)..(724): n is a, c, g, or t
  modified_base (726)..(726): a, c, t, g, unknown or other
  misc_feature (726)..(726): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtggaaggggcggtgaccatctccagagacaattacaagaacatgctgtatctgcgattgaacaacgtcagacgccgacacacggcccatatatgngngagagagagaaactaattaaagtttggcgggtactacgtaacggaagaacgggtnttacgggggcccgtcccggtacggggggacccgaaaacgggggacccctaaaccgggggttcaacgttcccgtacccgttcccgggccaaccggtccccgttaccccgaaacccgaaccggggtcccctaacgttcccgggttcccttccccccgtcgggaccccaccccgttccctacccgaacgaccgcgtacccgtaccggtcggggggggaccaaccgcgggccccggtccccggtcggggtccctcggtccccgttacgggaaccgtaaaccgggtaccttacccggttccggtagttccggtcccgttccgtcggttcggacgggccgggttaccgngggccgaaaggggcccacgttagtaacggngn

SEQ ID NO: 342144 - DNA, 641 bp, Homo sapiens
  misc_feature: GZ8MTXP01C4K4V.3.34.D01.1.454.CMB.2.raw
  modified_base (310)..(310): a, c, t, g, unknown or other
  misc_feature (310)..(310): n is a, c, g, or t
  modified_base (599)..(599): a, c, t, g, unknown or other
  misc_feature (599)..(599): n is a, c, g, or t
  modified_base (640)..(640): a, c, t, g, unknown or other
  misc_feature (640)..(640): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcgggtgaccatctaccagagaacaattaacaaagaacatgctagtatctgacgtattcgaacaacgtcagacgccgacgacacggaccctatattattgngacgagagagaagaactattaagttggcggtactacgtagagaacggagttcgggcccgcggtagggaccgaagggaccaacggtcaactccgtccgtccgactacgccctacccgaacgaacggccctacgtcccggtcccttaccccgcggtacccctacccctccgtaccgaacgacgcccgaaccgttcgggacggggggaccaaccggcggcccgggccgtggggccctggtaccccgtgaccgtaaaccgtccgttacgtccggagttccgtcgttcgttcgnggacggttccgggactcgggaacaacgggcctagagtcggng

SEQ ID NO: 342145 - DNA, 674 bp, Homo sapiens
  misc_feature: GZ8MTXP01EN5SX.3.34.D01.1.454.CMB.2.raw
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtggaaggggcggtgaccatctccagagacaattaacaagaacatgctgtatctgcgtattgaacaacgtcagagccgacgacacggccatattatgngcaganaganaataattaaagttggcgggactaacgtacgaagaaacggagttcggggccgccggtagggggacccaaagggggacccaacgggttcaacgtccgtccgtcccgacaccggccctacccgaacccgaacgggtccccagttcccggttcccgttccccccgtacggcccctacccccgttaccacccgaaacgaccgccaaccccgtcggttacggggggggggccaaccggacgcccgggccccgttgggccgttcgacccgttcgggtaaccgtaaacgggtaccgttacttaacccggtaaggttcggtcccgttcgttacgtcgggagggccgggacgtcggacgaacgggcgcagtaagngng

SEQ ID NO: 342146 - DNA, 677 bp, Homo sapiens
  misc_feature: GZ8MTXP01BR2E1.3.34.D01.1.454.CMB.2.raw
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgcgtgaagggcggtgaccatcnccaagagacaattacaagaacatgctgtatctgcattgaacacgtnagagccgacgacacggcctatattatgngacgagagaagagaaactaatttaaagttcggaccggtactaacgtaacggagtaaacggtgttcggggacccgccggtaggggaccgaaacggggacccaacgggtcaacgtccgtaccgcccggacaccgccgtacccgaacccgacgggaccctacgtccgtacccttcccccgtcggccctacccctcctaccgaaacgacgccgtaaccgtccgggtacgggggggggaccaaaccggtccgggacccgggtcccggtccgggtccgtccggccgttacgggtaaccgtaaaccgggtaccttaccgttaacggaacggttcggccgttccgtcggtcggacgggcgggttacgtcggacgaacggccgacgagtgngng

SEQ ID NO: 342147 - DNA, 524 bp, Homo sapiens
  misc_feature: GZ8MTXP02JABAS.3.34.D01.1.454.CMB.2.raw
  modified_base (523)..(524): a, c, t, g, unknown or other
  misc_feature (523)..(524): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaaggggccacggtcatcgtctccgcagcctccaccaagggcccatcggtcttccccctggcaccctcctccaacgacgcacctctgggggcacgagcggccctgggctgcctggtcaaggctacttccgagtgcgtctctcgacgcgggctggcaaggcgcatagnn

SEQ ID NO: 342148 - DNA, 525 bp, Homo sapiens
  misc_feature: GZ8MTXP02F5W0M.3.34.D01.1.454.CMB.2.raw
  modified_base (524)..(525): a, c, t, g, unknown or other
  misc_feature (524)..(525): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgctgtatctgcgattgaacacgtcagagccgacgacacggcccactattatgtgcgagagagagaacattaaatttggcgggctactacgagaacggattggggccgcctggggccaaggggaccacgggttcatcgtctccgcagcctccacaaggcccatcgtcttccccctgccaccctctccaagacgcacctctgggggcacgacgcggccctggctgcctggtcaaggactacttccgagtgcgtctcgtcgacgcggctggcgaaggcgcgatagnn

SEQ ID NO: 342149 - DNA, 531 bp, Homo sapiens
  misc_feature: GZ8MTXP02JXVWE.3.34.D01.1.454.CMB.2.raw
  modified_base (365)..(365): a, c, t, g, unknown or other
  misc_feature (365)..(365): n is a, c, g, or t
  modified_base (469)..(469): a, c, t, g, unknown or other
  misc_feature (469)..(469): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggccactatattgtgcgagagagagaacattaaattggcggctactacgagaacggattggggcnccgtgggggccaaaggggaccacgggtcatcgtctccgcagcctccaccaggcccatcggtctcccctgccaccctcctccaagcgcacctcgtgggggcacgngcggccctgggctcgccctggtcaaggctacttccgagtcgcgtctctgacgcggctggacg

SEQ ID NO: 342150 - DNA, 528 bp, Homo sapiens
  misc_feature: GZ8MTXP02IVG13.3.34.D01.1.454.CMB.2.raw
  modified_base (527)..(528): a, c, t, g, unknown or other
  misc_feature (527)..(528): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattatgtgcgagagagagaacattaaaattggcgggctactacgagacgattggcgccgtggggccaaggggaccacggtcagtcgtctccgcacgcctccaccaacgggcccactcgtcttcccctgcaccctcctccaacgacgcacctcgtgggggcacgacgcggcccgtggctgcctggcgaaggctacttccgagtcgcgtctcgtgacgcggctggcgaaggcgcatagnn

SEQ ID NO: 342151 - DNA, 551 bp, Homo sapiens
  misc_feature: GZ8MTXP02IAJ3Y.3.34.D01.1.454.CMB.2.raw
  modified_base (477)..(477): a, c, t, g, unknown or other
  misc_feature (477)..(477): n is a, c, g, or t
  modified_base (535)..(535): a, c, t, g, unknown or other
  misc_feature (535)..(535): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaaacatttaaaatttggcgggctactacgagaacggattggggcgcctgggggccaaaggggaccacgggtcatccgtctccgcacgcctccaccaacgggcccatccggtccttccccctggccaccctcctccaagacgcacctcncgggggcacgacgcggcctggggctcgcctggtcaaggactacttccgagtcgcgtcnctgagcgggctcggcg

SEQ ID NO: 342152 - DNA, 571 bp, Homo sapiens
  misc_feature: GZ8MTXP02H69TK.3.34.D01.1.454.CMB.2.raw
tcagagacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgctgtatctgcgatgaacaacgtcagagccgacgacacggccactattatgtgcgagagagagaacattaaaatttggcggcctactaacgagaacggattggggcgcctgggggccaaaggggacccacgggtcatcgtctccgcacgcctccaccaagggcccacgtcgtccttccccctcggccaccctcctcccaagacgccacctcgtgggggcacgacgccggcccgtcggggcctcggcccgttcgggtccaaacgggactaccgttcccgagtcgcgtctcgtcgacggcgggctcggacg

SEQ ID NO: 342153 - DNA, 518 bp, Homo sapiens
  misc_feature: GZ8MTXP02HS1IV.3.34.D01.1.454.CMB.2.raw
  modified_base (415)..(415): a, c, t, g, unknown or other
  misc_feature (415)..(415): n is a, c, g, or t
  modified_base (517)..(518): a, c, t, g, unknown or other
  misc_feature (517)..(518): n is a, c, g, or t
tcagagacgcactccacgaccggtgctcgatttagatcgtctgtgttgggtttggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggccatattatgtgcgagagagagaacattaaaattggcgggctaatacgaagaacggattgggccgcctggggccaaaggggaccaacggtcatcgtctcccgcagcctccaccaaggcccatcgtctccccngcaccctctccaagagcacctctgggggcacagcggccctgggctgcctggtcaagactacttccgagtgcgtctctcgacgcggcgcgcgacgcgcgacann

SEQ ID NO: 342154 - DNA, 540 bp, Homo sapiens
  misc_feature: GZ8MTXP02GG6OC.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcgggtgaccatctccagagacaattacaagaacatgctgtatctgcgattgaacaacgtcagagccgacgacacggcccactattatgtgcgagagagagaacataaatttggcggctactacgagaacggattgggcgcctgggggccaaaggggacccacgggtcatcgtctccgcagcctccaccaagggcccatcggtccttccccctcggccacccctcctccaagacgcacctcgtgggggcacgagcggccctgggctcgcctggtcaagggctactccgagtgcgtctctgagcggctggacg

SEQ ID NO: 342155 - DNA, 601 bp, Homo sapiens
  misc_feature: GZ8MTXP02JTMOX.3.34.D01.1.454.CMB.2.raw
tcagagacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattatgtgcgagagagagaacattaaattggcggctactacgagaacggattgggcgccgtggggccaaaggggccaggtcatcgtctccgcacgcctccacccaagggcccatccggtccttcccccgtggcccacccctccctcccaagacgccacccgtcgtcgggggcacgacggccgggccccgtcggggccttcggcccgttgggtaccgaaacgggtacctaaccgtttcccggaacggttcggccggttctccgttcggacggccgggggcgtacggggaccgg

SEQ ID NO: 342156 - DNA, 591 bp, Homo sapiens
  misc_feature: GZ8MTXP02IP426.3.34.D01.1.454.CMB.2.raw
  modified_base (363)..(363): a, c, t, g, unknown or other
  misc_feature (363)..(363): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaagggcggtgaccatctccagagacaattacaagaacatgctgtatctgcgattgaacaacgtcagagccgagacaccggccactattatgtgcgagagagagaacattaaattggcggctacgtacgagaacgattgggcnccgtaggggccaaaggggaccacgggtcagtccgtctccgcacgcctccacccgaacgggcccaacgtcccggtccttcccccgtcggcccaacccctccctacccaacgacgaccaccctcgtcgggggcaccgacgccggcccgtcgggctcggccgtcggtcaaacggaccttaccgttaccgaacgtcgccgttcgtcgtcggacgccggggcgtcgggaccgg

SEQ ID NO: 342157 - DNA, 534 bp, Homo sapiens
  misc_feature: GZ8MTXP02JKDA3.3.34.D01.1.454.CMB.2.raw
  modified_base (366)..(366): a, c, t, g, unknown or other
  misc_feature (366)..(366): n is a, c, g, or t
tcagagacgcactccacgaccggtgctcgatttagatcgtctgtgttgggtttggggagacctggttgagcctggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcgggtgaccatctccagagacaattacaagaacatgctgtatctgcgattgaacaacgtcagagccgacgacacggcccactattattgtgcgagagagagaacattaaattggcggctactacgagaacggattgggcncctggggccaaaggggaccacgggtcatcgtctccgcagcctcaccaaggcccatcggtctccccctggccaccctcctccaacgacgccacctcgtcgggggcacgagccggccctgggctcgcctggtcaaggactacttccgagtgcgtctctgagcggctggcg

SEQ ID NO: 342158 - DNA, 545 bp, Homo sapiens
  misc_feature: GZ8MTXP02FR52I.3.34.D01.1.454.CMB.2.raw
tcagagacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaaacggtcgtgctgataagacagcctacgcagacgccgtgaaggggcgggtgaccatctccagagacaattacaagaacatgctgtatctgcgattgaacaacgtcagagccgacgacacggccactattattgtgcgagagagagaaacattaaatttggcgggcctactacgagaacggattgggcgcctgggggccaaggggaccaggtcatcgtctccgcagcctccacccaaggcccatccggtcttcccccctggccacccctcctcccaaagagcacctcctgggggcacgagcggcccctgggctgccctggtcaaaggactacttccgagtgcgtctctgagcgggctggcg

SEQ ID NO: 342159 - DNA, 531 bp, Homo sapiens
  misc_feature: GZ8MTXP02JVDSH.3.34.D01.1.454.CMB.2.raw
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
tcagagacgcactccacgaccggtgctcgatttagatcgtctgtgttgggtttggggagacctggttgagcctgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaagggcgggtgaccatctccagagacaattacaagaacatgctgtatctgcgattgaacaacgtcagagccgacgacacggccactattatgtgcgagagagagaacattaaattggacggctactacgagaacggattgggcgccgtggggccaagggaccaggtcatcgtctccgcagcctccacaaggcccatcgtcttcccctgacccnccnccncacgacgcactcgcgggcgacgacgcgccgcggcgtcgcgtcggcgacgacgtacgtaccgcgtcgcgtcgtcgtcgcggcggcgtcggcg

SEQ ID NO: 342160 - DNA, 529 bp, Homo sapiens
  misc_feature: GZ8MTXP02HEW8F.3.34.D01.1.454.CMB.2.raw
  modified_base (365)..(365): a, c, t, g, unknown or other
  misc_feature (365)..(365): n is a, c, g, or t
tcagagacgcactccacgaccggtgctcgatttagatcgtctgtgttgggtttggggagacctggttgagcctggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattatgtgcgagagagagaacattaaattggcggctactacgagaacggattggggcncctgggggccaaaggggaccacgggtcatcgtctccgcagcctccaccaagggcccatcggtctcccctggccaccctcctccaagagcacctctgggggcacagcgccctgggctcgcctggtcaaggactacttccgagtcgcgtctctgagcggctggacg

SEQ ID NO: 342161 - DNA, 589 bp, Homo sapiens
  misc_feature: GZ8MTXP02H2WQF.3.34.D01.1.454.CMB.2.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
  modified_base (419)..(419): a, c, t, g, unknown or other
  misc_feature (419)..(419): n is a, c, g, or t
tcagagacgcactccacgaccggtgctcgatttagatcgtctgtgttgggtttgggggagacctggttgagcctggggggtccctgagactcgcctgcgcaccttctggattcaccttttagtacatatgtcatgacctgggtacgccaggctccgagggaaggggctggagtgggtcgcaagtataaacggtcgtgctgataagacagcctacgcagacgccgtgaagggcggtgaccatcncagagacaattacaagaacatgctgtatctgcgattgaacaacgtcaagagccgacgacacggcccatattattgngcgagagagagaactaatttaaattggcggctacgtacgagaacggattgggcgccgtggggaccaaaggggaccacgggtcagtccgtctcgcacgccnccgaccgaacgggcccagtccggtccttcccccgtggcccacccctcctacccaacgacgccacccgtcgtcgggggaccacgacggccggcccgtgggccgtcggcccgttggtacgaaggaccttacgtcccggagtcgtcgtctcgtaggcggcgggtcgtcggacg

SEQ ID NO: 342162 - DNA, 552 bp, Homo sapiens
  misc_feature: GZ8MTXP02F9F1N.3.34.D01.1.454.CMB.2.raw
  modified_base (412)..(412): a, c, t, g, unknown or other
  misc_feature (412)..(412): n is a, c, g, or t
tcagagacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattgaacaacgtcagagccgacgacacggcccactattatgtgcgagagagagaaacattaaatttggcggctactacgagaacggattgggcgccgtggggaccaaggggaccacgggtcatcgtctccgcacgccnccaccaacgggcccatccggtcttccccctggccacccctcctccaagacgccaacctccgtgggggcacgacgcggcccgtgggctcgccctggtacaaggactacgttcgagtcgcgtctctggacgcgggctggacg

SEQ ID NO: 342163 - DNA, 574 bp, Homo sapiens
  misc_feature: GZ8MTXP02HU4W0.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcgggtgacatctccagagacaattacaagaacatgctgtatctgcgattgaacaacgtcagagccgacgacacggcccatatattgtgcgagagagagaacattaaattggcggctactacgagaacggatgggcgcgtggggaccaaagggaccagtcatccgtctccgcacgccctccaaccgaacgggcccagtccggtcccttcccccgtggccctacccctcctaccaacgacgccacctcgtcgggggcacgacggccggcccgtggggcctcgcctggtaccaaggaccttacgttccgagttcgccgttcgtcgtcggacgccggggactcgggacg

SEQ ID NO: 342164 - DNA, 558 bp, Homo sapiens
  misc_feature: GZ8MTXP02GN08B.3.34.D01.1.454.CMB.2.raw
  modified_base (396)..(396): a, c, t, g, unknown or other
  misc_feature (396)..(396): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaaagaacatgctgtatctgcgattgaacaaacgtcagagccgacgacacggcccactattatgtgcgagagagagaaacattaaaatttggcgggctactacgagaacggattgggccgcctggggccaaaggggaccacggttcatcgtctccgcagcccnccaccaacgaccactcgtccttcccctcgcaccctccctccaacgacgcacctcgtcggggcgacgacgcgggcccgtcgggcgtcgccgtcggtacgaaacggaacgtaacttaccgtacgtgcgtctctcgacgcggcgtggcgaacggacgacanagan

SEQ ID NO: 342165 - DNA, 602 bp, Homo sapiens
  misc_feature: GZ8MTXP02G61PA.3.34.D01.1.454.CMB.2.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctcagagacaattacaagaacatgctgtatctgcgattgaacaacgtcagagccgacgacaccggccatattatgngcgagagagagaactatttaaagttggcggactacgtagagaacggngtgggcnccgtggggaccaagggacccagggtcatccgtctccgcgacgccctccgaacccgaacggccccagttccggtcccttcccccgtcggcccaccccgttccctaccaacgcgcctaccgtcgtcgggggccacgacggccggcccgtgggcctcggccgtggtaccgaacgggtaccttaccgtccggtacgtcgccgttcgtacgtcggacggccgggtcctagggaccgg

SEQ ID NO: 342166 - DNA, 550 bp, Homo sapiens
  misc_feature: GZ8MTXP02FFF35.3.34.D01.1.454.CMB.2.raw
  modified_base (550)..(550): a, c, t, g, unknown or other
  misc_feature (550)..(550): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttatactgtgcgagagattcgagtggtcgggacctcaccctggttctacttcgatctctggggcctggcaccctggtcactgtctcctcagcctcaccaaagggcccatcggtccttccccctggccgccctgctccgagacgcaccctccgagacgcacacggcggccccgtggggctggcctggtcaaaggactaccttccggagtcgcgtctcgtgaggcggcgtggacaaggcgcatgn

SEQ ID NO: 342167 - DNA, 557 bp, Homo sapiens
  misc_feature: GZ8MTXP02I7E24.3.34.D01.1.454.CMB.2.raw
  modified_base (358)..(358): a, c, t, g, unknown or other
  misc_feature (358)..(358): n is a, c, g, or t
tcagagacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctcagagacaattacaagaacatgctgtatctgcgattgaacaacgtcagagccgacgacacggcccactattatgtgcgagagagagacattaaattggcggcctactagagaaccggnttgggcgccgtggggcccaaagggccaggtcatcgtctccgcacgcctccaccgacggcccatcggtcctcccccgtgccaccctcctcccaacgacgccacctcgtcggggccacgacgccggcccgtgggcctcgcctggtcaacggacctacgtcccgtagtcgccgttctccgtggacggcgggcgtcggaccgg

SEQ ID NO: 342168 - DNA, 578 bp, Homo sapiens
  misc_feature: GZ8MTXP02GMBKA.3.34.D01.1.454.CMB.2.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctagcagacgccgtgaaggggcggtgaccatctcagagacaattacaagaacatgctgtatctgcgattgaacaacgtnagagccgacgacacggccatattatgngcgagagagagaactattaaagttggcggactacgtacgagaacggtagttggggcgccgtggggaccaaaggggacccagggtcagttccgtcctccgcacgcctccgaaccgacgggcccacgtccggtcccttcccccgtcggcccacccctccgtaccaacgacgccaccgtcgtcgggggcacgacgccggcccgtggctcgccgtaggtacgaacggactacgttccgagtcgcgtctcgtcgacggcggcgtcggacg

SEQ ID NO: 342169 - DNA, 592 bp, Homo sapiens
  misc_feature: GZ8MTXP02I7G88.3.34.D01.1.454.CMB.2.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacacgtcagacgccgacgacacgccatattatgtgcgagagagagaaactattaaagttggcggacctacgtacgagaacggtnttcgggcnccggtggggaccaaaggggacccacgggtcagtccgtccgtccgcacgcctcccaccgaacggcccacgtccggtcctccccgtcgacccacccctcctaccaagacgaccacccgtcgtcggggcacgacgccggccgtggccgtcgccgtggtaccgaaacggtaccttaccgtaccgacggtcgccgtcgtaccgtggacggcgggcgtcggaccg

SEQ ID NO: 342170 - DNA, 670 bp, Homo sapiens
  misc_feature: GZ8MTXP02IIAF4.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccgagggaaggggctggagtgggtcgcaagtataaacggtcgtgctgataagacagcctagcagacgcgtgaaggggcggtgaccatctccagagacaattacaagaacatgctgtatctgcgattgaacaacgtcagagccgacgacacggccatatattgtgcgagagagaagaaactaatttaaatttgggacggcctaacgtacgaagaacggattcggggacgccggtgggggaccaaaagggggtacccacggggtcaagttccgtctccgcacgccctaccaaccgaaacgggcccagtccggtccttcccccgtggccctaacccctccctaccctaaacgacgaccaacccgttccgacgggggacaaccgacggtcccgggccccgttacgggggcctcggtacccgttggggtacctaaaacggggaaccttaccgttaaccccggtaggttccggccggttacccgtaccgttgggaacggtccggggtaccggtcgggaaccggg

SEQ ID NO: 342171 - DNA, 564 bp, Homo sapiens
  misc_feature: GZ8MTXP02JYPIR.3.34.D01.1.454.CMB.2.raw
  modified_base (341)..(341): a, c, t, g, unknown or other
  misc_feature (341)..(341): n is a, c, g, or t
  modified_base (563)..(564): a, c, t, g, unknown or other
  misc_feature (563)..(564): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaattggcgggctactacgagaacggnttggggccgccgtggggccaaaggggaccacggtcagtcgtctcccgcagccctccaccaacggcccatccggtccttccccctggccacccctcctcccaacgacgccaacctcgtcgggggcacgaggccgggccctggggcctcggccgtggtaccaagggtactaaccgtttcccggagttcgccgtctctcgacggcgggctggccaaggcgcatgnn

SEQ ID NO: 342172 - DNA, 646 bp, Homo sapiens
  misc_feature: GZ8MTXP02F8ERI.3.34.D01.1.454.CMB.2.raw
  modified_base (304)..(304): a, c, t, g, unknown or other
  misc_feature (304)..(304): n is a, c, g, or t
  modified_base (635)..(635): a, c, t, g, unknown or other
  misc_feature (635)..(635): n is a, c, g, or t
  modified_base (645)..(646): a, c, t, g, unknown or other
  misc_feature (645)..(646): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctcagagacaattacaagaacatgctgtatctgcgtattgaaacaacgtcagacgccgaacgacaccggccctactattattgngacgagagaagagaaactaatttaaaagttggacgggtctaacgtacgaagaacggattcggggccgccgtggggaccaaaggggacccaacgggtcagtccgtctccggaccacgcccctaccgaaacccgaaacgggacccacgtcccggtcccttcccccgtcggcccacccctccctacccgaaacgacgccaacccgtcgtcgggggaccacgacggcccgggcccgttcggggctcggtcccgtacggtaccgaacggtaaccgtaccgttaccggagtcggtcgtcgtccgtggacggcggggcgtaacgggcgaacggggacncgtaagacgnn

SEQ ID NO: 342173 - DNA, 633 bp, Homo sapiens
  misc_feature: GZ8MTXP02JT5D6.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattattgtgcgagagagagaacattaaatttggcggcctactacgagaacggattggggcgccgtgggggcccaaaggggacccacggtcatccgtactccgcacgcctcccacccgaacgggccccagtcccggttccttccccccgtcgggccacccctcctaccccgaaagacgccgacctccgttcggggggccaccgacggcccggccccgtcgggggcctcggcccgttggggttaccaaacgggggtaccttaaccgttcccggaaggttcgccggttccttccgttcggacggccgggggcgttcgggaaccgg

SEQ ID NO: 342174 - DNA, 663 bp, Homo sapiens
  misc_feature: GZ8MTXP02IZTV1.3.34.D01.1.454.CMB.2.raw
  modified_base (295)..(295): a, c, t, g, unknown or other
  misc_feature (295)..(295): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggcccactattatgngcgagagagagaacatttaaaagtttggacgggtactaacgtacggaagaacggattcggggccgccgtgggggaccaaaggggacccacggggttcagttccgtccgtcccggcacgccctaccgaacccgaaacggggccccaagtcccgggtccctttccccccgtcgggcccgtcccccgtggccctacccgaaggggactccgaaccccgttccggaacgaagcccaaccgacggtcccgggccccgttgggggcctacggcccgttgggtacgaaaacgggtaccttaacgtttcccggaagttcggcccgttctccgtggacggcggggcctaggggacccgaaagggtcgaccaagtcgg

SEQ ID NO: 342175 - DNA, 610 bp, Homo sapiens
  misc_feature: GZ8MTXP02HB20C.3.34.D01.1.454.CMB.2.raw
  modified_base (316)..(316): a, c, t, g, unknown or other
  misc_feature (316)..(316): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcggtgaccatctccagagacaattacaagaacatgctgtatctgcgattgaacaacgtcagagccgacgacacggccatattatgncgagagagagaactaatttaaagttgggacggacctacgtacgaagaacggtagttggggcgccggtagggggaccaaaggggacccacggtcagtccgtactccgcgacgcctacccaccgaacggcccacgtccggtcccttcccccgtcggcccacccctccctaccaacgacgcaccgtcgtcgggggacacgacggccggcccgtgggacctcggccgtggtacgaaacggtaccttaccgttaccgagttcggccgttcgtacgtcggacggtcggggcgtcgggacg

SEQ ID NO: 342176 - DNA, 526 bp, Homo sapiens
  misc_feature: GZ8MTXP02I3U2G.3.34.D01.1.454.CMB.2.raw
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
tcagagacgcactccacgaccggtgctcgatttagatcgtctgtgttgggtttgggggtccctgagactcgcctgcgcaccttctggattcaccttttagtacatatgtcatgacctgggtacgccaggctccagggaagggctggagtgggtcgcaagtataaacggtcgtgctgataagacagcctacgcagacgccgtgaaggggcggtgatcatctccagagacaattacaagaacatgctgtatctgcgattgaaacaacgtcagagccgacgacacggcccactattattgncgagagagagaacattaaaatttggcggactactacgagaaacggattgggcgcctggggccaaaggggaccacgggtcatcgtctccgcacgcctccacaaggcccatcggcttccccngcaccctctccaagagcacctctggggcacagcggccctgggctagccttggcaaaggactacgttccgagtgcgtcttcgcgngcggcgcgacgacgacgacacagn

SEQ ID NO: 342177 - DNA, 770 bp, Homo sapiens
  misc_feature: GZ8MTXP02HUUNQ.3.34.D01.1.454.CMB.2.raw
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctccagagacaattacaagaacatgctgtatctgcgattagaacaacgtcagacgccgacgacaccggcccactattatgtgcgagagagagaaacaatttaaagttggacggtacctaacgtacggaagaaacggtagtttcggggccgccggtacgggggacccgaaaagggggaccccgtaacggggtcaacgttcccggtccttcccgccacgcccctacccaacccgaaacgggccccctaacgttcccgggttccccctttccccccgtccgggtacccctacccccttccccttaacccgaaacgaccgtaccgaaccccgttccggtacgggggaccaaccggaccgggccccgggtccccggtcgggggtcccgttcgggtaccccggtttcggggtaaacccggtaaaacggggttaaccctttacccggtttaacccgggtacggtttaccgggtcccggtttccgtaccggttcggggaccgggtcccgggggtcccgtttacgggggaaacccggg

SEQ ID NO: 342178 - DNA, 623 bp, Homo sapiens
  misc_feature: GZ8MTXP02JLVNY.3.34.D01.1.454.CMB.2.raw
  modified_base (320)..(320): a, c, t, g, unknown or other
  misc_feature (320)..(320): n is a, c, g, or t
  modified_base (372)..(372): a, c, t, g, unknown or other
  misc_feature (372)..(372): n is a, c, g, or t
tcagagacgcactccacgaccggtgctcgatttagatcgtctgtgttgggtttgggggagacctggttgagccgtggggggtccctgagactcgcctgcgcaccttctggattcacctttagtacatatgtcatgacctgggtacgccaggctccaggggaaggggctgggagtgggtcgcaagtataaacggtcgtgctgataagacagcctacgcagacgccgtgaaggggcgggtgaccatctcagagacaattacaagaacatgctgtatctgcgattgaacaacgtcagagccgacgacacggccactatattgngcgagagagaagaaactattaaagttggacggacctacgtacgaagaacggngttagggccgcgtggggaccaaaggggaccacggtcatcgtactcgcacgccctaccgacgtaacggcccagtccggtacctcccccgtacggcccaacccctccgtacccaaagaccgaccaaccgtccggcgggggaccaccgacggcccggccccgttcgggcccgttcgcccgttggaaccgtaacggtacccttacgttaccggagttcgaaccggttcgtcggacggcgggcacgggacgaacgg

SEQ ID NO: 342179 - DNA, 641 bp, Homo sapiens
  misc_feature: GZ8MTXP02I3A4H.3.34.D01.1.454.CMB.2.raw
  modified_base (300)..(300): a, c, t, g, unknown or other
  misc_feature (300)..(300): n is a, c, g, or t
  modified_base (640)..(640): a, c, t, g, unknown or other
  misc_feature (640)..(640): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccgagggaaggggctggagtgggtcgcaagtataaacggtcgtgctgataagacagcctagcagacgccgtggaaggggcggtgaccatctccagagacaattacaaagaacatgctgtatctgcgattagaacacgtcagacgccgaacgacaccggcccatattatgngcgagagagagaaactagtttaaagttcgggacgggtactacgtaacggaaggtaacggtagttcggggccccgtccggtggggacccaaaggggcccacgggtcagtccgttacgcccgcaaccgtccctaccgaaccgaacgggcccctagtcccgggtcccttaccccggtcgaccctacccctccctaccgaaacgcgccgtaccgtcgggtcgggggaccctacgaccggccgggtcccgtagggtctccggccgttaggaccgaaacggtactaccgtcggagttcgtcgttctacggtcgacggtcggtcgcggacgacggacgacacgtgcng

SEQ ID NO: 342180 - DNA, 590 bp, Homo sapiens
  misc_feature: GZ8MTXP02GTMW2.3.34.D01.1.454.CMB.2.raw
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
  modified_base (588)..(589): a, c, t, g, unknown or other
  misc_feature (588)..(589): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctagcagacgccgtgaaggggcggtgaccatctcagagacaattacaagaacatgctgtatctgcgattgaacacgtcagagccgacgacacggcccactattatgtgcgagagagaagaacagttaaaagtttgggacgggtctaactacgagaaacggngttcgggccgccgtggggccgaaagggccacggtcagtccgtactcccgnacgccctaccaccgaacgggcccaacgtccgttccttccccctgggccctacccctcccgtaccaacgacgcctaccgtccgtagggggcacgacgccggtcccgtgggctcggcgtacggacgaacggacttaaccgttccgagttcgcgttactcgtcggacggcggcgtggcaaggcgacgaagtcgnng

SEQ ID NO: 342181 - DNA, 638 bp, Homo sapiens
  misc_feature: GZ8MTXP02GNVVQ.3.34.D01.1.454.CMB.2.raw
  modified_base (637)..(638): a, c, t, g, unknown or other
  misc_feature (637)..(638): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctccagagacaattacaagaacatgctgtatctgcgtattgaacaacgtcagagccgacgacaccggcccactattatgtgcgagagagagaactagtttaaagttggcggtactaacgtacgaagaacggagttgggcccgccgtggggacctaacggggaccacggtcacgtccgtcctccgccacgcccctaccgaaccgaaaccggggcccaacgtcccgtacccctttcccccgcggtacccctacccccgttcccaacccgaaacgaccgcccgtaacccgttcgggtccgggggaccaaccgacggtcccgggccccgtcggggcctcggcccgtggtacgaacggtaccttaccgttcgagtcgccgttctccgtggacggccggtcgcggacgaacgggcacgagacgnn

SEQ ID NO: 342182 - DNA, 548 bp, Homo sapiens
  misc_feature: GZ8MTXP02FQIU7.3.34.D01.1.454.CMB.2.raw
  modified_base (305)..(305): a, c, t, g, unknown or other
  misc_feature (305)..(305): n is a, c, g, or t
  modified_base (542)..(542): a, c, t, g, unknown or other
  misc_feature (542)..(542): n is a, c, g, or t
  modified_base (546)..(548): a, c, t, g, unknown or other
  misc_feature (546)..(548): n is a, c, g, or t
tcagagacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcgggtgaccatctccagagacaattacaagaacatgctgtatctgcgattgaacaacgtcagagcgacgacacggccactatatgtgcgagagaganaacattaaattggcgggactactacgagaacggattgggcgccgtggggcaagggaccaggtcagtcgtctccgcagccctccacaacggcccatccggtccttcccctcggcccacccgtcctaccaacgacgtcaccgtcgtgggggcacgacgccggcccgtcggctcgccgtcggtacaaggactacgttccgagtcgtctcgtcggacgccggcgtcggcgaacggcgacanacgnnn

SEQ ID NO: 342183 - DNA, 585 bp, Homo sapiens
  misc_feature: GZ8MTXP02JP864.3.34.D01.1.454.CMB.2.raw
  modified_base (296)..(296): a, c, t, g, unknown or other
  misc_feature (296)..(296): n is a, c, g, or t
  modified_base (391)..(391): a, c, t, g, unknown or other
  misc_feature (391)..(391): n is a, c, g, or t
  modified_base (583)..(584): a, c, t, g, unknown or other
  misc_feature (583)..(584): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtggaaggggcggtgaccatctaccagagaacaattacaaagaacatgctgtatctgcgattgaacacgtcagacgccgacgacacgccatatatgngagagagagagaactattaagttggacggtactacgtacgagaacgtgtcggcccgccgtggggaccaaggggccacggtcacgtcgtctccgcncgccctccacgaacgccctacgtccgtccctccccgtcgaccctaccctccctacccgaacgtacgccgtaccgtcggtcggggcacgacggcccggtccgtcggcgtcgcgtcggacgaacgtccgtaccgtccgacggtcgtccgtcgtacgtcgaccggcggtcgtcggcgaacggcgacgacgtacgnng

SEQ ID NO: 342184 - DNA, 644 bp, Homo sapiens
  misc_feature: GZ8MTXP02I3U98.3.34.D01.1.454.CMB.2.raw
  modified_base (288)..(288): a, c, t, g, unknown or other
  misc_feature (288)..(288): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcggtgaccatctccagagacaattacaagaacatgcttgtatctgcattgaacaacgtnaagagccgacgacacggcccatattatgtgcgaagagagagaactaagtttaaagttgggcggacctaacgaacgagaaacggagttcggggctccggtggggacccgaaaggggccccaaggggtcaagtccgtcctccgcgacgccctacccaacccgaacgggacccacgtccggttacctcccccgtcgacccacccccgttccctacccgaaacgaccgaccgaacccgtccgtacgggggacccacggacggccgggtccccgcggggtccgtcgccgttacggacgtaaacggacccgttacgtaccggtcgtcgtccgtctcgtcggacggccgggcgtacggaccgg

SEQ ID NO: 342185 - DNA, 608 bp, Homo sapiens
  misc_feature: GZ8MTXP02JSNMH.3.34.D01.1.454.CMB.2.raw
  modified_base (316)..(316): a, c, t, g, unknown or other
  misc_feature (316)..(316): n is a, c, g, or t
  modified_base (465)..(465): a, c, t, g, unknown or other
  misc_feature (465)..(465): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctagcagacgccgtgaaggggcggtgaccatctccagagacaattacaagaacatgctgtatctgcgattgaacaacgtcagacgccgacgacacggccatattatgngcgagagagagaactaatttaaagttgggacggtaccttacgtacgaagaacggtagttggggccgtccgtgggggaccaacggggccacgggtcagttccgtcctccgcacgcctccacccgacggcccacgtccggtcctcccccgngccacccctcctacccgaagccgcaccctcggtcggggacaccgacgcccggcccgtcgggccgtcggccgttcggacgaacggtaccttaaccgtccggacgtcgtccgttcgtccgtggacggccggggtcgtcggaccgg

SEQ ID NO: 342186 - DNA, 834 bp, Homo sapiens
  misc_feature: GZ8MTXP02I967F.3.34.D01.1.454.CMB.2.raw
tcagagacgcactccacgaccggtgctcgatttagatcgtctgtgttgggtttggggagacctggttgagcctgggggtccctgagactcgcctgcgcaccttctggattcacctttagtacatatgtcatgacctggtacgccaggctccgagggaagggctggagtgggtcgcaagtataaacggtcgtgctgataagacagcctacgcagacgccgtggaagggcggtgaccatctccagagacaattaacaagaacatgctgtatctacgattagaacaacgtcagacgccgaacgaccaccggaccctacttaacttagtttgtagacgaaggaacggaaagacggtaaacttaaagtttaaaacgttttacggggaccggggtaccttaacccgttaacggaaacgggtaaaccgggtaacgtttcggggacccggtccccggtacggggggaacccccgtaaaacgggggacccccgaaccggggttaccgtaacgttcccggttacccgtaccccgccgtaacccgggtaccccctacccggaaaccccgaaaccggggccccctaaacggttcccccgggttacccgtttcccccccgtacgggaccccctacccccgttaccccgttaacccgaaacgttaccgacccgtaaccccgttccggtaccgggggcccaaaccggccggcccgggtcccccgtaggggcccgttacggaaccccggttgggtaaacccgtaaacggtaacccgttaccgttacccgtacggttacgtcccgtcgtacgttcggaacgggcccgggtgtaccgggacgtaaaccgggg

SEQ ID NO: 342187 - DNA, 754 bp, Homo sapiens
  misc_feature: GZ8MTXP02I9H9C.3.34.D01.1.454.CMB.2.raw
  modified_base (303)..(303): a, c, t, g, unknown or other
  misc_feature (303)..(303): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccaggggaagggctggagtgggtcgcaagtataaacggtcgtgctgataagacagcctagcagacgccgtaggaaggggcggtgaccatctccagagacaatacaagaacatgctgtatctgcgtattagaacaacgtcgagacgccgacgaccaccggccctatattagtgngacgagagagaacgtaactaatttaaaaggttggaccgggtacttaacgtaacggaagaacgggtagttcggggaccccgtacccggtgggggaacccaacgggggtaaccaccgggttaccacgttcccgtccgtcccgacctaccggcccctaccgaaacccgaaccgggccctaacgtccgttcgttccccttcccccgtcggtaccccctacccccgttaccctacccgaaacgtaccggacctaccccggttcgggtccgggggaccaccggaccgggaccccggtccccggtgggtcccgtcggtacccggttcgggtaaccgtaacggttaacccgttaaaccgttccgggtaacggttcggtacccggtttaccgttcggtacgggtacggccgggggtcggtacgggaccggtaaacggggcccgaccgtaaacgtacggcg

SEQ ID NO: 342188 - DNA, 742 bp, Homo sapiens
  misc_feature: GZ8MTXP02IKGLP.3.34.D01.1.454.CMB.2.raw
tcagagacgcactccacgaccggtgctcgatttagatcgtctgtgttgggtttgggggagacctggttgagcctgggggggtccctgagactcgcctgcgcaccttctggattcaccttttagtacatatgtcatgacctgggtacgccaggctccagggaaggggctggagtgggtcgcaagtataaacggtcgtgctgataagacagcctacgcagacgccgtaggaaggggcggtgaccatctccagagaactaattaacaagaacatgctagtactctgacgtaattagaactaacgtacagacgaccgaacgaccaccggaccctaacttattattagtgacgagaggaagaagaaactaagtttaagtcgggacggtactacgtaacgaggaacggtagttcggggccgtccgggtacggggaccgaaacggggacccaccgggtctactccgtcgtccgccacgtccctaccgaacccgacgggacccctacgttcccggttcccgttcccccgtacggtacccctacccccgttaccctacccgtaacgaccgtccgtaacccccgtcggtaccgggggtacccacggtaccgggcccggtcccgtcggggtccgtcggtcccggttacgggtaaccgtaaacggtaacccgtttaccggttaaccggtacggtttacggtcccggttccgttacggtacggggaacgggtccggggaccgttacgggaaccgg

SEQ ID NO: 342189 - DNA, 687 bp, Homo sapiens
  misc_feature: GZ8MTXP02HGH3D.3.34.D01.1.454.CMB.2.raw
  modified_base (146)..(146): a, c, t, g, unknown or other
  misc_feature (146)..(146): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
tcagagacgcactccacgaccggtgctcgatttagatcgtctgtgttgggtttgggggagacctggttgagccgtggggggtccctgagactcgcctgcgcaccttctggattcacctttagtacatatgtcatgacctgggtacnccaggctccgaggggaaggggctggagtgggtcgcaagtataaacggtcgtgctgataagacagctacgcagacgccgtggaaggggcggtgaccatctacgagaagaacaattaacaagaacatgctagtatctgacgattaggaaacaacgtcacgacgccgaacgacaccggccctattattagtgngagagagaganaataattagttcggcggtacctacgaagacgaaagtgttacgggccgccggtcgggggaaccgaaacggggacccacgggtacacgttccgtacctccgaccaccgacccgtcccgaacccgaacgggccccgtaccggttcccggttaccccgttcccccgttccggcccctaccccgtcccgtacccgaacgaccgcccgtaacccgtccggtccgggggacctacgacggtcccggtcccggtcgggtccgtcgtcccggttacggtaccggtaaacggtaccttaaccggtcgacgtcgtccgttcgtcgtacggcgccggggcgtacggaaccgg

SEQ ID NO: 342190 - DNA, 784 bp, Homo sapiens
  misc_feature: GZ8MTXP02IXN2H.3.34.D01.1.454.CMB.2.raw
  modified_base (316)..(316): a, c, t, g, unknown or other
  misc_feature (316)..(316): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggcggtgaccatctccagagacaattacaagaacatgctgtatctgcgattagaacaacgtcagacgccgacgacacgccactatatgngcgagagagagaaactaatttaaagtttcgggacggtacctaacgtaacggaacgtaaacgggtagtttcggggaccgtccgggtcgggggaacccgaaaacgggggacccgaccgggttcgaaacgttcccggtaccgttcccggaccaccgtccccgtacccaaacccggaaaccggggcccctaaccgttcccgggttccccttacccccccggtcgggccccctaaccccccgtttccccgttaaccccgaaacggacccggtaccctaaacccccggttccggttaccggggggaccctaacgggtaaacccgggcccgggtcccccgggtcgggggtacccgttccgggtccccggtttacgggacccggtaaaacgggtacccgtttaccgttacccggtacggttcggtaacccgttccgttacgtcgggaacggtccggggtcgttacggggaacccgg

SEQ ID NO: 342191 - DNA, 676 bp, Homo sapiens
  misc_feature: GZ8MTXP02I36OQ.3.34.D01.1.454.CMB.2.raw
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
tcagagacgcactccacgaccggtgctcgatttagatcgtctgtgttgggtttgggggagacctggttgagcctgggggggtccctgagactcgcctgcgcaccttctggattcacctttagtacatatgtcatgacctgggtacgccaggctccgagggaaggggctggagtgtgtcgacaagtataaacggtcgtgctgataagacagcctacgcagacgccggtaggaaggggcggtagacatcnccagagacaattacaagaacagtnctgtatctgacgtattagaaacaacgtcgaagacgaccgaacgaccacggacccctactattattggtgcgaagagagaagaaactattaaagttcggaccggtactaacgtacgaaggaacggtagttacgggccggtccggtacgggggaccgaaacgggacccgtacggtacacgttcgctccgacacgccctaccgaccgacggcccacgtccgtccttcccccgtcgcccctacccgtacccaccgtaaaccgcgacccgtacccgtcgggtacggggaccaaccggcggacccgggtcccgtgggtcccgtcgtacccgtacgggaccgaaacggtaccttaccgttaccggacgttcgtccggttccgttcggacggtaccgggtcggcggtacggg

SEQ ID NO: 342192 - DNA, 623 bp, Homo sapiens
  misc_feature: GZ8MTXP02IE40D.3.34.D01.1.454.CMB.2.raw
  modified_base (221)..(221): a, c, t, g, unknown or other
  misc_feature (221)..(221): n is a, c, g, or t
  modified_base (321)..(321): a, c, t, g, unknown or other
  misc_feature (321)..(321): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
  modified_base (578)..(578): a, c, t, g, unknown or other
  misc_feature (578)..(578): n is a, c, g, or t
  modified_base (622)..(623): a, c, t, g, unknown or other
  misc_feature (622)..(623): n is a, c, g, or t
tcagagacgcactccacgaccggtgctcgatttagatcgtctgtgttgggtttgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaagggggcggtgaccatcnccagagacaaattacaaagaacatgctgtatcgtgcgatttgaaacaacgtcagacgccgaacgacaccggccccatactttatgtgcgaaggagaaganaaaactatttaaaagtttggacgggctaacgtaacgaaggaaacggtnttcggggcccgtaccggtggggacccaaaggggtaccccaacggggttcagttccggttacncccggcaccggtccctaccgaaacccgaaacggggcccaacgtccgggttcccttcccccgtcggccacccctcctccaagacgcaccgtcgtcggggcaccgacgcggcccgtcggctcgccgtagtcgaacggtactacttacgngtcgcgtcgtcgtcgacggcggcgtggacgaacgcgactagacnn

SEQ ID NO: 342193 - DNA, 589 bp, Homo sapiens
  misc_feature: GZ8MTXP02FGUKQ.3.34.D01.1.454.CMB.2.raw
  modified_base (145)..(145): a, c, t, g, unknown or other
  misc_feature (145)..(145): n is a, c, g, or t
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
tcagagacgcactccacgaccggtgctcgatttagatcgtctgtgttgggtttgggggagacctggttgagcctggggggtccctgagactcgcctgcgcaccttctggattcacctttagtacatatgtcatgacctgggtacnccaggctccagggaaggggctggagtgggtcgcaagtataaacggtcgtgctgataagacagcctacgcagacgcgtgaagggcggtgacatctcagagacaattacaagaacatgctgtatctgtnattgaacaagtcagagccgacgacgacgccatatattgtncgagagagagaaactataagttggaggcctacgacgagaacgagttcggcgcgtcgggggaccaaaggggccagggtcactcgtcncgtcacgcctccaccgaacggcccacgtcggtcccttacccccgtggccctacccgacctacccaagacgacaccgtccgtacgggggccacgacgccggacccgtcgggcctcggcccgtggtaccaacggtacctaccgttcccgaagttcgccgtacgtcgtacggacggtaccgggcgtacggacgg

SEQ ID NO: 342194 - DNA, 616 bp, Homo sapiens
  misc_feature: GZ8MTXP01A80ZD.17.34.D01.1.454.CMB.2.raw
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagcgtagactagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctggaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcactcaccctgccccgattaacgtgacaggaaccccttggtcttccggcgagcgggcttttcgaccgctttatcgttaccttatgtcagcaattcgcacttctgatacctcagcatncncacacncacacctacacacgactacacgaaccgaccgtacccctaaccccaaaccaaccgaccaacgtaacgaccgtccgccgtcgccgccgacgtcgttcggttcgtcgttacgttacggttaccggttccccgttccttccctaaccttccttccccgtccctaccttacctcgttaacgtaacg

SEQ ID NO: 342195 - DNA, 560 bp, Homo sapiens
  misc_feature: GZ8MTXP01APZ23.17.34.D01.1.454.CMB.2.raw
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagcgtagactagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgccttcggcctcgccttaggggtcgactcaccctgccccgattaacgtggacaggacccttggtcttccggcgagcgggcttttcacccgtntttatcgttaccttatgtcagcaattcgcacttctgactacctcagcatgcctcacagcacaccttnacagcttaacagaaccgcctcccctaccaacaacgcataagcgtcgctgccgcagcttcggngccagtcggtttanccccgtttnactcttcccgcatcttgaacttaagtcc

SEQ ID NO: 342196 - DNA, 561 bp, Homo sapiens
  misc_feature: GZ8MTXP01AQ44L.17.34.D01.1.454.CMB.2.raw
  modified_base (381)..(381): a, c, t, g, unknown or other
  misc_feature (381)..(381): n is a, c, g, or t
  modified_base (433)..(433): a, c, t, g, unknown or other
  misc_feature (433)..(433): n is a, c, g, or t
  modified_base (506)..(506): a, c, t, g, unknown or other
  misc_feature (506)..(506): n is a, c, g, or t
  modified_base (522)..(522): a, c, t, g, unknown or other
  misc_feature (522)..(522): n is a, c, g, or t
  modified_base (532)..(532): a, c, t, g, unknown or other
  misc_feature (532)..(532): n is a, c, g, or t
tcagcgtagactagcacgaccggtgctcgatttagatcgtctgtgttgggtttgggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcacccctgccccgattaacgtggacaggaaccccttggtcttccggcgagcgggcttttcaccgntttatcgttacttatgtcagcaattcgcacttctgatacctcagcatgcctnacagcacaccttcacaggcttacagaaccgctccctaccaacaacgcataagcgtcgctgccgcagcttcggngccagtcgggtttacnccccgttttnacttccttcccgctatcttgcttaagtcc

SEQ ID NO: 342197 - DNA, 552 bp, Homo sapiens
  misc_feature: GZ8MTXP01E3K8E.17.34.D01.1.454.CMB.2.raw
  modified_base (510)..(510): a, c, t, g, unknown or other
  misc_feature (510)..(510): n is a, c, g, or t
  modified_base (521)..(521): a, c, t, g, unknown or other
  misc_feature (521)..(521): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactaccgcacagaagttcccaagggcaagactcacccataaccgcggacaaattaacgaacacagttaatctggagctagaacagccctgtcatcgtgaggacacgggcttctacttctgtgcgagagtaattaactaattaacacttgccttccttttaccncccttcccttnacttcgtcgggccactccggaaccccgtccc

SEQ ID NO: 342198 - DNA, 562 bp, Homo sapiens
  misc_feature: GZ8MTXP01D6VKE.17.34.D01.1.454.CMB.2.raw
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtccccccttcgcagtaacaccaagtacaggaatattaacctgtttcccatcgactacgcctttcggcctcgccttaggggtcactcaccctgccccgattaacgttggacaggaacccttggtcttccggcgagcgggtcttttcacccgtctttatcgttacttatgtcagcaattcgcacttctgactacctcagcatgcctcacagcacaccttcacagcttacagaaccgctacccctacccaaacaacgcaactaagctcgctgccncagctggncagtggttacncccgtttcactccttccgcctatcttcgaacttgtaacc

SEQ ID NO: 342199 - DNA, 607 bp, Homo sapiens
  misc_feature: GZ8MTXP01C9FRV.17.34.D01.1.454.CMB.2.raw
  modified_base (440)..(440): a, c, t, g, unknown or other
  misc_feature (440)..(440): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatataacctgtttcccatcgactacgcctttcggcctcgccttaggggtcactcaccctgccccgattaaacgtggacaggaacccttggtctccggcgagcggcttttcaccgtctttatcgttaccttatgtcagcaattcgcactttctgactaccctcagcatgcctcacgacncactaccttacacgagactaacaacgaaccgcctacccctaaccaaacaacgacaactaacgccgtacgctcgcccgcacgtcgttcggttcgtacttagtttacgggtttaccgttccccgtttcaccttcccttccccgctactcttacgtaaccgttcgtaacc

SEQ ID NO: 342200 - DNA, 609 bp, Homo sapiens
  misc_feature: GZ8MTXP01DTAGT.17.34.D01.1.454.CMB.2.raw
  modified_base (335)..(335): a, c, t, g, unknown or other
  misc_feature (335)..(335): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgacttatagtttcaattgggtgcgacggctctggacaggccttgagtggatgggaagatcgtccctatcgttnacacacaaactccgcacagtagtccaagggcaagactcaaccactaaccgcggaacaaattaaacgaaacaacaagttaaatctaggaagactagaacacgcctgtacatcgtagaggacgacgggtcttacgttacttcgtagtcgtacgagtaagttaattaactaattaactacttcgttaccttttcctttttaaccttccctttacccgtttgtaacccgtttcgttaccgggggcccttacggttcccgggttaacccccgtttcccg

SEQ ID NO: 342201 - DNA, 526 bp, Homo sapiens
  misc_feature: GZ8MTXP01DV8CQ.17.34.D01.1.454.CMB.2.raw
  modified_base (364)..(364): a, c, t, g, unknown or other
  misc_feature (364)..(364): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctccatctcctgcaagtctagtcagagcctctgcatagtggtagaaggaaagaccttcttatattggtcctgcagagccaggccagtctccacacctcctgatttacgaacgtttccaacgcttcgctggactgccagataggtcagtggcagcgggtnagggacagtattttacactagaaaatcaggccgggtggaggcgtaggagggtacgttaggtaatttatactgtatgtacaaggtatagaacgtcttccgtccgacggttccggaccgaacggggaccaagggtgaactaacgaaacgacttgtggcgtaacg

SEQ ID NO: 342202 - DNA, 558 bp, Homo sapiens
  misc_feature: GZ8MTXP01D3PD5.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggctccatctcctgcaagtctagtcagacgcctcctgcataggtggtagaaaggaaacgtacctttcttatattggttccctgcagacggccaggccagtcctccacctaccttcctagtactttacgtaacgtttcccaacgtcttcgctcggactgccagtagttacggtcaggtggcgaggcgggtcgagggactagtatttacactagaaatcgagccgggtaggagcggtaggaggtacgttaggtaatttatacgtgtagtgtagtaaggtataggaacgtcttccgtccgttacgttccggacgaacgggacgaaggtaagaactaacgaaacgacttgtgcgtaacg

SEQ ID NO: 342203 - DNA, 603 bp, Homo sapiens
  misc_feature: GZ8MTXP01DNPUY.17.34.D01.1.454.CMB.2.raw
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaaacatagccttctccgtcccccttcgcagtaacaccaagtacagaatattaacctgttcccatcgactacgcctttcggcctcgccttagggtcactcaccctgccccgattaacgtgacaggaacccttggtcttccggcgagcgggcttttcaccccgtctttatcgtttaccttatgtcagcaattcgcacttcngactacctcagcatgcctcacagcacaccttnacagctanagaaccncctcccctaacccaacaaccgacaataacgcgtacgctcgcccgcacgtcgttcggttcgtcgttaacgttcggtttaaccgttccccgttttcaccttcctttccccgccctactccttcggtaaccttcggttaacccg

SEQ ID NO: 342204 - DNA, 564 bp, Homo sapiens
  misc_feature: GZ8MTXP01EPNXU.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgtgacacaccaaactaccgcacagaagttccaagggcaagactcaccataaccgcgaacaaataacgaacacagtaatctaggagctagaacagcctgtacatcgtagaggacacgggtcttctacttctgtgtcgaggtagtaattaactaattaactacttcgtccttccttttacgcccttacccttcgtacttcgtcgggtccttacgtccggttaaccccgtcccg

SEQ ID NO: 342205 - DNA, 563 bp, Homo sapiens
  misc_feature: GZ8MTXP01DBUV8.17.34.D01.1.454.CMB.2.raw
  modified_base (511)..(511): a, c, t, g, unknown or other
  misc_feature (511)..(511): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaagatcgtcctatcgttgacacacaaactccgcacagaagtccaagggcaagactcaaccataaccgcgaacaaattaacgaacacaagtaatctaggagactagaacagcctagtcaatcgtagaggacacgggcttctacttctgtgcgaggtagtaattaactaattaactacttgtccttccttttaccncccttcccttcgtacctttcgtcggggccttacgtccggaaccccggttccg

SEQ ID NO: 342206 - DNA, 618 bp, Homo sapiens
  misc_feature: GZ8MTXP01DQFDE.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctcggtgagggtctcctgcaaggcttcgtggaggcaccttcagcgactatagttcaagttgggtgcgacgggctctggacaaggccttgagtggatgggaagatcgtcctatcgttgacacaccaaactaccgcacagaagtccaagggcaagactacacataaccgacgacaaataacgaactacaagttaatcgtaggacactagaacacgccgtatacatacggtaggaacggacgtaccgggtcttccttacgttctaggtcgacggtaggtaacttaaatttaactaacttaaacctacgttcgtacctttcccttttaacccgttccctttacccttaagtacctttcggtacggggtacccttacggtaacccgggttaacccccgttccg

SEQ ID NO: 342207 - DNA, 591 bp, Homo sapiens
  misc_feature: GZ8MTXP01DM6G7.17.34.D01.1.454.CMB.2.raw
  modified_base (323)..(323): a, c, t, g, unknown or other
  misc_feature (323)..(323): n is a, c, g, or t
  modified_base (532)..(532): a, c, t, g, unknown or other
  misc_feature (532)..(532): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagttcaattgggtgcgacgggcctctggacaaggccttgagtggagtgggaagntcgtccctatcgttgacacaaccaaactaccgcacagaacgttcccgaagggcaagactacaacccaataaacccgacggaaacaaacttaaacgaaacacaagttaaatctaggaagctagaacagcctgtacatacgtgaggacgacgggcttctacttctgtgcgaaggataattaactaattaacacttgtccttccttttaccncccttcccttgtacctttcgttcggggacccttacgtccggttaaccccgggttaaccc

SEQ ID NO: 342208 - DNA, 551 bp, Homo sapiens
  misc_feature: GZ8MTXP01CTP41.17.34.D01.1.454.CMB.2.raw
  modified_base (322)..(322): a, c, t, g, unknown or other
  misc_feature (322)..(322): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttctggaggcaccttcagcgactatagtttcaattgggtgcgacgggctctggacaaggccttgagtggatgggaagntcgtccctatcgtgacacacaactcgcacagaagtccaagggcaagactcaaccataaccgngaacaaataacgaacacagtatctaganctagaacagctgtacatcgtgaggacacgggtcttctacttctgtcgcgaggataattaactaattaactacttgtaccttcttttaccttccttcccttgtaccttcgtcggggaccttagtccggaaccccggttcc

SEQ ID NO: 342209 - DNA, 592 bp, Homo sapiens
  misc_feature: GZ8MTXP01C037P.17.34.D01.1.454.CMB.2.raw
  modified_base (376)..(376): a, c, t, g, unknown or other
  misc_feature (376)..(376): n is a, c, g, or t
  modified_base (512)..(512): a, c, t, g, unknown or other
  misc_feature (512)..(512): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccggacaaccgtcgcccgccaacatacgccttctcccgtcccccttcgcagtaacaccaagtacaggaatataacctgttcccatcgactacgcctttcggcctcgccttaggggtcactcaccctgccccgattaacgtgacaggacccttggtctccggcgagcggcttttcacccgtntttatcgttacttatgtcagcaattcgctacttctgactacctcagcatcgcctcacagcaacaccttcacgacggcttaacacgtaacccgcctaccccctaaccaaccaacgcaataacgcctacgctcgcccncacgccttcggcgcttagttcggtttaacgttccccgtttcacttcccttcccgcctatccgttacgtaacttaacgtcc

SEQ ID NO: 342210 - DNA, 578 bp, Homo sapiens
  misc_feature: GZ8MTXP01D7ZUW.17.34.D01.1.454.CMB.2.raw
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (544)..(544): a, c, t, g, unknown or other
  misc_feature (544)..(544): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgtggacaggacccttggtcttccggcgagcgggcttttcacccgtctttatcgttacttatgtcagcaattcgctacttctgactacctcagcatcgcctcacagcacaccttcacaggcttacacgaaccgcctacccctaacccaaacaacgcaataacgccgtacgctcgccncngcttcggngcagttcggttacgccccgtttnacttccttcccgctatcttacgtaacttaagtcc

SEQ ID NO: 342211 - DNA, 633 bp, Homo sapiens
  misc_feature: GZ8MTXP01C6FUH.17.34.D01.1.454.CMB.2.raw
  modified_base (435)..(435): a, c, t, g, unknown or other
  misc_feature (435)..(435): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcaagtaacaccaagtacagaatacttaacctcgttccatcgactacgtccttcggcctcgcgtagggtcactccacctcgcctattacgtgacacggaccttgtctcggcgacgtcggtctttccgaccgtgtttactacgtttaccttatgtcagctaaattcgctacttctgtactaccctcagcagtccncctacacacgaccacctacctcacgtacgtactaacgacgaaccctccctaacccctaaccaaaccaaccgacaacgtaacgcgtcgcgtccgccgacgcgtcgttcggttcgtacgttacgtttccggtttacccgttcccgttcttaccgttccccgtcccgtaaccttacgttcgttaccgtaacgttcgttccg

SEQ ID NO: 342212 - DNA, 558 bp, Homo sapiens
  misc_feature: GZ8MTXP01DMZSZ.17.34.D01.1.454.CMB.2.raw
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatggaagatcgtccctatcgttgacacaccaaactcgcacagagttccaagggcngactcaaccataacccgnggaacaaattaacgaacacagtaatctagagctagaacagcctgtacatcgtgagggacacgggcttctactttctagtgtacgaggtacgtaattaactattaactacttgtcttccttttaccaccttcccttgtactttctcggggtccacgtccggaaccccgttccg

SEQ ID NO: 342213 - DNA, 560 bp, Homo sapiens
  misc_feature: GZ8MTXP01ASJ1Z.17.34.D01.1.454.CMB.2.raw
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatggggaagatcgtccctatcgttgacacaccaaactccgcacagaagtccaagggcaagactcaaccataaccgcggaacaaataacgaacacaagttaatctaggagctagaacagcctgtacatcgtgaacggacgacgggtcttctacttctgtgtcgagacgtaattaactaattactacttgtcttccttttacnccttcccttntacttcgtcggggccttacgtcggttaaccccgtccg

SEQ ID NO: 342214 - DNA, 575 bp, Homo sapiens
  misc_feature: GZ8MTXP01BP3LB.17.34.D01.1.454.CMB.2.raw
  modified_base (366)..(366): a, c, t, g, unknown or other
  misc_feature (366)..(366): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (513)..(513): a, c, t, g, unknown or other
  misc_feature (513)..(513): n is a, c, g, or t
  modified_base (553)..(553): a, c, t, g, unknown or other
  misc_feature (553)..(553): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaaccgggacaaccgtcgcccggccaacatacgccttctccgtcccccttgcagtaacaccaagtacagaatattaactgttcccatcgactacgccttcgcctcgcttagggcactcacctgccctatacgtgacaggaccctggtctcggcgagcggtctttcaccgtntttatcgttaccttatgtcagctaattcgctacttcagactacctcagcatcgcctnacancactaccttcaacngcttaacacgaaaccncctacccctaaccaaacaacgcaactaacgcgtcgctcgccgcagtcttcgggacncttagttcgttacgcccgttcttcctaaccttccctcccncctacttccgtcgttaacgtcg

SEQ ID NO: 342215 - DNA, 534 bp, Homo sapiens
  misc_feature: GZ8MTXP01AR9PI.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctccatctctgcaagtctagtcagagcctcctgcatagtggtagaaaggaaagtacctttcttatatttggttcctgcagagccaggccagtcctccacacctctgatttaccgaacgtttccaacgtcttcgctggactgccagataggttcagtcggcaggcggtcgagggacagtactttacacttagaaatcgaggccgggtagggaggcgtggaggtacgttaggtaatttagttactgtatgtacaagggtatgaacgtcttccgtaccgcgttcggacgttaacgggccaagggtggaactaacaacggattcggtgcgtcg

SEQ ID NO: 342216 - DNA, 654 bp, Homo sapiens
  misc_feature: GZ8MTXP01CHGL5.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctccgtggggctgctaatgctctggatacctggatccagtgcagatattgtgatgacccagacctccactctctctcgtccgtcacacctggacacgccgcctccatctcctgcaagtctagtcagagcctctgcagtagtggtagaaaggtaaacgtacctttcttattagttggttcctgcagacggccaggcccagtcctaccacctacctctagtactttacgaacgtttcccaacgtcttcgctcgggactgacctagagttaggttcaggtcggcaggcgggtacagggactagtatttacacgtagaaactcgacgggccgggtaggacggtcggtagggtaaggtacggtttaggttaaattttacgttacgttaggttaagttacggaacggttaaaggttacgtaaggtaacgttcccgtttacccgtaaccgggttaccgggttaccgggaaccggttaaacgggggaaccgttaaacggggtaacggtaaaaccgtaaccgaaaacggtaccgttagggtcggttcgtaaccgg

SEQ ID NO: 342217 - DNA, 562 bp, Homo sapiens
  misc_feature: GZ8MTXP01EGSTA.17.34.D01.1.454.CMB.2.raw
  modified_base (418)..(418): a, c, t, g, unknown or other
  misc_feature (418)..(418): n is a, c, g, or t
  modified_base (475)..(475): a, c, t, g, unknown or other
  misc_feature (475)..(475): n is a, c, g, or t
  modified_base (513)..(513): a, c, t, g, unknown or other
  misc_feature (513)..(513): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtgggagggaccttcagcgtactatagttcaagtgggtgcgacgggcctgtggacaaggcttgagtggatgggaagatcgtcctatcgtgacacacaaactcgacacagaagtcccgagggacagaactcaaccataaccgagaacaaattaacgaacacagtaatctaganactagaacagcctgtacaagtctagggaacggacaacgggtcttctacttctgtcgngtagtaagtaatactaataacatcttcttacctttacnccttccttcgtaacttcgtcggctagttaccgtaacccgttctaacccg

SEQ ID NO: 342218 - DNA, 564 bp, Homo sapiens
  misc_feature: GZ8MTXP01BXBYT.17.34.D01.1.454.CMB.2.raw
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaagttgggtgcgacgggcctntggacaaggccttgagtggatgggaagntcgtccctatcgtgacacaccaactaccgcacagaagttccaagggcaagactcaccataaccgcgaacaaatacgaacacagtaatcaggagctagacagcctgtcatcgtgaggacacgggtcttctacttcgtcgtgcggtaggtaagttaattaactaattaacgtacttgtcctttaccttttaccttaccttcccttgtaccttcgtcgggtccacgttccggttaaccccgtccg

SEQ ID NO: 342219 - DNA, 577 bp, Homo sapiens
  misc_feature: GZ8MTXP01EM0IU.17.34.D01.1.454.CMB.2.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaagttgggtncgacgggcctctggacaaggccttgagtggatggaagntcgtcctatcgtnacacacaaactccgcanagaacgtccaagggcaagactacaaccataacccgacggaaactaaataacgaaacaacaagttaatacgtaggacgactagaacagcctgtacatcgtagaggacgacgggtcttcgtacttctgtgcgagtagtaattaactaattacacttgtcctttaccttttacttccttccttgtaccttcgtcgggtccttacgtaaccggttaaccccgttaaccg

SEQ ID NO: 342220 - DNA, 592 bp, Homo sapiens
  misc_feature: GZ8MTXP01DQPFA.17.34.D01.1.454.CMB.2.raw
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
  modified_base (509)..(509): a, c, t, g, unknown or other
  misc_feature (509)..(509): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttgcagtaacacaagtacagaatattaacctgttcccatcgactacgccttcggcctcgcctagggtcactcaccctgccccgattaaacgtgacaggaacccttggtcttccggcgagcgggtcttttcacccgtntttatcgttacctatgtcagcaattcgcacttcngactaccctcagcatcgctcacancacaccttacacagctacacgaacacctacccctaacccaaaccaaaccgacaacaaacgacgtcgcctcgccgcncgtcgtcgttcgtcgttacgttacgtttacgttcccgttccttactccttcccgtcctactcttacgtaacgttaacgtaacg

SEQ ID NO: 342221 - DNA, 596 bp, Homo sapiens
  misc_feature: GZ8MTXP01BUX9Q.17.34.D01.1.454.CMB.2.raw
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (525)..(525): a, c, t, g, unknown or other
  misc_feature (525)..(525): n is a, c, g, or t
  modified_base (558)..(558): a, c, t, g, unknown or other
  misc_feature (558)..(558): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgatttttccggatttgcctggaaaaaccagcctacacgcttaaaccgggacaaccgtcgcccggcaacatacgccttctccgtcccccttgcagtaacaccaagtacaggaatattaacctgttcccatcgactacgccttcggcctcgcttagggtcgactcaccctcgccccgtattaacgtgacacggaacctggtcttccggcgagcgggtctttcaccgtctttatcgttaccttatgtcagcaattcgcacttcngactacctcagcatgcctnactagcaaccaccttcacaggcttaacagaaccgcctcccctaaccaacaacgcaagtaacgccgtacgctcgaccggtcaggtcgttcggngtccagtttcgggtttaaccgttccccgttttnacttcccttcccgcctatcttagtaacttaacggtccg

SEQ ID NO: 342222 - DNA, 609 bp, Homo sapiens
  misc_feature: GZ8MTXP01ENWM4.17.34.D01.1.454.CMB.2.raw
  modified_base (321)..(321): a, c, t, g, unknown or other
  misc_feature (321)..(321): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagttcaagttgggtgcgacggcctctggacaggccttgagtggatgggaagntcgtccctatcgtgacacaccaaactaccgcacagaacgttccgaagggacaacgactcaacccaataacccgacggaacaaattaacgaacaacagttaatctagagtactagaacacgctagtacatcgtagaacggtaccacgggtacttcgtacttcgtagtcgacggtaaggtagttaaattaactaattaactacttacgtacctttcccttttaccttccctttcccttcgtacctttcggtcggggtacccttacgtccggttaaccccgggttaacccg

SEQ ID NO: 342223 - DNA, 569 bp, Homo sapiens
  misc_feature: GZ8MTXP01A69V0.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaagttgggtgcgacgggcctctggacaaggccttgagtggatgggaagatcgtccctatcgtgacacacaactaccgcacagaagttcccaagggcaagactcaaccataaccgcggaaacaaattaaccgaacaacaagttaatctaggagactagaacacgcctagtcatcgtgaggacacgggtcttctacttctgtgcgaggtattaataactaattactacttgtcctttccttttacttcccttcccttgtaccttcgtcggggtccttacgtccggaaccccggtccg

SEQ ID NO: 342224 - DNA, 847 bp, Homo sapiens
  misc_feature: GZ8MTXP01C8ALC.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatcgacccagactccactctctctgtccgtcacactggacagccgcctcatctcctgactaagtctagtcaagcgccctctgctaagtaggtagggtaggaaaggtaaaacgttacctttacttaattagtttcggtttaccctgacgaggaccggtccgacggcccacgttccctacccaacctacccttccgtacgtaacgtttaaccgtaaccgtttaccccaaaccgtcgttccgcgtaacgggacctcggaccgtaaggtaacgttacgggtcgtaagggtcgggaccgtaggggtccgggttacggaacgggggtaactaacggtttaaacgtttttaaacaaaccgttaaaggtaaaaacgttccgggtaaacggggacccgggggttaagggggtaacccggggttacgggttaaagggggttaaacgggggtttaaaccgggttttaaagggttaaaagtttttttaaaccgtttaacgggtttagtttaaagtttagggaaaccggttaaaagggtacgttaaacgggtaacgtttacccgtttaccccggttaacccgggttacgggtttacccgggaaccgggttaaaaccggggttaaccggttaaacggggttaacgggtaaaaaccttaaccggtaaaacggtaacgttcgggttaacggttccggtaacccg

SEQ ID NO: 342225 - DNA, 556 bp, Homo sapiens
  misc_feature: GZ8MTXP01CCYEY.17.34.D01.1.454.CMB.2.raw
  modified_base (283)..(283): a, c, t, g, unknown or other
  misc_feature (283)..(283): n is a, c, g, or t
  modified_base (323)..(323): a, c, t, g, unknown or other
  misc_feature (323)..(323): n is a, c, g, or t
  modified_base (510)..(510): a, c, t, g, unknown or other
  misc_feature (510)..(510): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaagttgggngcgacggcctcgtggacaggccttgagtggagtgggaagntcgtcctatcgtgacacacaaactaccgcacagagtccaagggcaagactacaccataaccgacgaacaaataacaacactagtaactactaggagactagaacagcctgacatcgtgaggacgacggtcttctacttgtgtgtacgagtagtaattaactaattactacttgtccttccttttacncccttccttgtcttcgtcgggccttacgtccggttaacccgtcccg

SEQ ID NO: 342226 - DNA, 564 bp, Homo sapiens
  misc_feature: GZ8MTXP01ARM93.17.34.D01.1.454.CMB.2.raw
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcagtaacaccaagtacaggaatattaacctgtttcccatcgactacgcctttcggcctcgccttagggtcactcaccctgccccgattaacgtgacaggaccctggtcttccggcgagcgggcttgccagttnctactangtnancaatcgcactctnactctcancnctcncncacacacactacctacacacgactacacgaccaccgtaccctaacccaaccaacgacacacgacgtcgctcgccgcgcgtcgtcggttcggtcgttcgttcgtcccgttcgttcttcctccctcctctctcgttactaacgttcgtcg

SEQ ID NO: 342227 - DNA, 640 bp, Homo sapiens
  misc_feature: GZ8MTXP01D3WYO.17.34.D01.1.454.CMB.2.raw
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgaggtctcctgcaaggcttctggaggcaccttnagcgactatagtttcaagttgggtgcgacgggcctcgtggacaaggccttggagtggatgggaagactcgtccctatcgttgacacaccaaactaccgcacagaacgtccaagggcaagactcgaaccataaccgcggaactaaaacttaacgaaacaactagttaatacgtaggaacgctagaacagacctgtacactcgtaggaggaaccgtaacggggtcctttccgtactttcctaggttggaccgtaaggtaagttaaattaactaattaaactaacttcgtacctttccctttttaaccttccctttaccccttaacggttacctttccggttacggggtacccttacgttcccgggttaaacccccgggttcccg

SEQ ID NO: 342228 - DNA, 664 bp, Homo sapiens
  misc_feature: GZ8MTXP01A07NZ.17.34.D01.1.454.CMB.2.raw
  modified_base (181)..(181): a, c, t, g, unknown or other
  misc_feature (181)..(181): n is a, c, g, or t
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
  modified_base (565)..(565): a, c, t, g, unknown or other
  misc_feature (565)..(565): n is a, c, g, or t
  modified_base (580)..(580): a, c, t, g, unknown or other
  misc_feature (580)..(580): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccngcctacacgacttaaaccgggacaaccgtcgcccggccaacatacgccttcctcccgtcccccttgcagtaacaccaagtacaggaatattaacctgttacccatcgactacgtccttcggcctcgcgttaggggtcacctccaccctcgaccccgtattaaccgttggaacctaggtaaccccttggtccttccgggcgacggtccgggtcctttccgacccgtctttatcgttacttntgtcagctaattcgctacttctgactacctcagctatcgcctcaacncgcaacctccttanaaccgagtaccttacaacgaccccgcccttaccccaaaccccaacgaaccgtcaaacgtacgccgttaccgcgtccgccgacncggtccgtttcgggntaccgttgttccgggtttaaccgcccccgttttcacccgttcccctcccgtaacttacgtccgttacgtaaccgttcgtaaccg

SEQ ID NO: 342229 - DNA, 593 bp, Homo sapiens
  misc_feature: GZ8MTXP01AYM22.17.34.D01.1.454.CMB.2.raw
  modified_base (247)..(247): a, c, t, g, unknown or other
  misc_feature (247)..(247): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctgggtgagggtctctgcaaggcttcgnggagcaccttcagcgactatagtttcaagttgggtgcgacgggcctgtggacaaggtccttggagtggagtgggaagtctcgtcctagtcgtnacacacaactcgnacagacgtcgaagggcngactcaccanaccgcgaacaaatacanacagtactgaganctagacngctgtacatcgngacggacgtacggtcttacgtacgttcgtaggtcgtacggtagtacgttaaactaactaacgttacctacgttcgttaccgtttaccctttttaaccgccctttacccgttgtacccgtttcggtacgggtaccttacggtaacccgggttaaccccgttcccg

SEQ ID NO: 342230 - DNA, 579 bp, Homo sapiens
  misc_feature: GZ8MTXP01C41CJ.17.34.D01.1.454.CMB.2.raw
  modified_base (432)..(432): a, c, t, g, unknown or other
  misc_feature (432)..(432): n is a, c, g, or t
  modified_base (530)..(530): a, c, t, g, unknown or other
  misc_feature (530)..(530): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaattgggtgcgacggcctctggacaggccttgagtggagtgggaagatcgtccctatcgtgacacacaaactaccgcacagaacttccgaaagggcaagactacaaccaactaacccgcggaaacaaacttaacgaacaactaagtaatcgtaggaanacgtagaacacgacctgtacatcgagacggacacgggtcttcctacttctgtgcgtagtagttaataactaattaactacttcgtccttcttttaccncccttacccttcgtacttcgtcggaccttacgtccggaaccccgtcccg

SEQ ID NO: 342231 - DNA, 559 bp, Homo sapiens
  misc_feature: GZ8MTXP01BEEO5.17.34.D01.1.454.CMB.2.raw
  modified_base (296)..(296): a, c, t, g, unknown or other
  misc_feature (296)..(296): n is a, c, g, or t
  modified_base (367)..(367): a, c, t, g, unknown or other
  misc_feature (367)..(367): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggtcttcgtggaggcaccttcagcgactatagttcaagttgggtgcgacgggcctntggacaaggtccttgagtggatgggagatcgtcctatcgtgacacacaactcgcacagacgtccaagggcngactacaaccactaaccgcgaaacaaataacgaacactagtaatcgtagagtactagaacacgcctgtacatcggtacgacggaccacgggtcttctacttcgtagtgcgtagtacgtaattaactaattaactcttctccttactttacacccttcctgtaccttcgtcgggaccacgtcgaaccccgtcc

SEQ ID NO: 342232 - DNA, 614 bp, Homo sapiens
  misc_feature: GZ8MTXP01DZICP.17.34.D01.1.454.CMB.2.raw
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (537)..(537): a, c, t, g, unknown or other
  misc_feature (537)..(537): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggcaacatagccttctcccgtcccccttgcagtaacaccaagtacagaatattaacctgttcccatcgactacgccttcggcctcgcgtagggtcactcaccctgccccgatacgtgacagaccttgtctcggngagcggtctttcaccgtnttatcgttacttatgtcagctaattcgcactttctgaactaccctcagcatcgcctacactagccaactaccttacaacaggtccttaacaacgaaacccgccctaccccctaaacccaaacaaccgacaacgtaacgccgttacgctcgccgcaggtccttcgggttcncgttaggttcggtttaccgttccccgttttcaccttcccttaccccgtctaacttccttacgtaaccttgttaaccg

SEQ ID NO: 342233 - DNA, 588 bp, Homo sapiens
  misc_feature: GZ8MTXP01AW3MB.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctccatctcctgcaagtctagtcagacgcctcctgcagtaggtggtagaaaggaaacgtaccctttcttaattagtttcggttccctggacaggacggccaaggccctagtccctccaacctccttcctagtactttacgaaccgtttccaacgtcttcgctaggactgaccagtattaggtcaggtggcaggcggtacgagggacagtatttacactagaaatcgaggccgggtgaggcggtaggaggtacgttaggtaatttagtatgtatagtagtaaggtataggtaacgtcgttccgtaccggacgttaccgggaccgaacgggttaccgaagggtaacggaaactaaccgaaacggtacgttcggtaacggctaacg

SEQ ID NO: 342234 - DNA, 572 bp, Homo sapiens
  misc_feature: GZ8MTXP01BMV9C.17.34.D01.1.454.CMB.2.raw
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (521)..(521): a, c, t, g, unknown or other
  misc_feature (521)..(521): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagtttcaagttgggtgcggacgggcctctggacaaggccttgagtggatgggaagntcgtccctatcgtagacacaccaaactccgcacagaacgtccaaagggcngactcaccataaccgcgaacaaataacgaaacacagtaatctaggagctagaacacgacctgtacatcgtgaggacacgggtcttcctacttctgtgcgtaaggtagtaattaactaattaactacttcgtctttaccttttaccncccttccttgtaccttcgtcggggccttacgtccggttaacccccggttcc

SEQ ID NO: 342235 - DNA, 611 bp, Homo sapiens
  misc_feature: GZ8MTXP01A5JXY.17.34.D01.1.454.CMB.2.raw
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (552)..(552): a, c, t, g, unknown or other
  misc_feature (552)..(552): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncgacggctntggacaaggccttgagtggatgggaagntcgtccctatcgtgacacacaactccgcacagaagttcccgaagggcaaggactacaacccataaccgcggaacaaaattaacgaacaactagttaatctaggaagctagaacagcctgtactaagtcgtaggaacggaccaacggggtccttacgttacgtttcgtaggtcgaccggtagggtaacttaaattaactaaattaactacttacgtacctttaccttttaccnccctttcccgttaagtaccttcgttcggggaccttagtcccggttaaccccggttcccg

SEQ ID NO: 342236 - DNA, 680 bp, Homo sapiens
  misc_feature: GZ8MTXP01EBDV2.17.34.D01.1.454.CMB.2.raw
  modified_base (277)..(277): a, c, t, g, unknown or other
  misc_feature (277)..(277): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgacttaaaccgggacaaccgtcgcccggcaacatacgccttctcccgtccccccttgcaagtaacaacaagtacagaatactaacctnttacccatcgactacgtccttcggcctcgccgttagggtcactcaccctcgacccgtattacgtgacacggtaccttggtctcggcgagtcggggtctttcgaccgtntttactcgtttaccttatgtcacgctaaacttcgctacttcgtactactacctcgaanctctcaccacacacacctacctacctacacgacgtacctaacgaccgtaaccctacccctaacccctaaaccgaaacctaaccgaacgtaacgtaccgaccgtaccgtccgtaccgccgtacgtcggtcgttaccgggttactacgtttaccggtttacggtttaccccgttcccgtttcttacccttcccgttaccccgtaacgttacttcgttacgttaaccgttccgttaaccg

SEQ ID NO: 342237 - DNA, 742 bp, Homo sapiens
  misc_feature: GZ8MTXP01DRR59.17.34.D01.1.454.CMB.2.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctcggtgaggtctccgtgcaaggtcttcgtggagcctaccttcagcgtacttagtagtttcaagttgggtgcggacggctcgtggacaggtccttagagtggacgtaggaagtctcgtccctagtcgtagacacacaactcgacacgagtactcgaaggcaacgactacaacacgtaaccgacgaaactaaacttaacgaactaacgtaagttaacgtcgttaacggaacgtccgttaaggaaccacggtaccttacggtacctaacgttacggggttaacggaacgggtaaccgtaccggggttcctttaccgttaacgtttccggttaggtacgggtaaccggttaaaggggttaaacgtttaaacgtttaaaccgttaaacttaaaccggttaaccgtttaccgtttaaccctttttaccccgtttttaaacccttcccgtttacccgtttaacgttaacccgtttccggtaccgggggtacccttacggttaaccccgggttaaccccggtttccccg

SEQ ID NO: 342238 - DNA, 581 bp, Homo sapiens
  misc_feature: GZ8MTXP01A5EUC.17.34.D01.1.454.CMB.2.raw
  modified_base (320)..(320): a, c, t, g, unknown or other
  misc_feature (320)..(320): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcagcttctggagcaccttcagcgactatagttcaagttgggtgcgacggcctcgtggacaaggccttggagtggatgggaagntcgtccctatcgtgacacacaactcgcacagaacgtccgaagggcaagactacaccataaccgngaacaaataacgaacactatatcgtagagcgtanaacacgctgtacatcgtagaggacgacgggtcttcgtacttcgtgtcgtcggtaggtacgtaattaactaacttaactacgttcgtacttcccttttaccttacccttcccttcgtaccgttccgtcgggtacccgttacgtcccgggttaaccccgttcccg

SEQ ID NO: 342239 - DNA, 686 bp, Homo sapiens
  misc_feature: GZ8MTXP01DPDMB.17.34.D01.1.454.CMB.2.raw
  modified_base (279)..(279): a, c, t, g, unknown or other
  misc_feature (279)..(279): n is a, c, g, or t
  modified_base (396)..(396): a, c, t, g, unknown or other
  misc_feature (396)..(396): n is a, c, g, or t
  modified_base (458)..(458): a, c, t, g, unknown or other
  misc_feature (458)..(458): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgacgttaaaaccgggacaaccgtcgcccggacaacatacgccttctcccgtcccccttgcaagtaacacaagtacagaatattaacctnttccatcgactcgccttcgctcgccgttagggtcactcaccctgaccccgtaattaaacgtggaacacggtaaccccttggtccttccgggcgtaggccggtcttttccgacccgtntttactcgtttaccttatgtacagctaaacttcgctacttctagtactaccctcagctatcncctacacacaccaaccctaccttacaacgtaacggtaccttaaccgaaccgtaacccgtcccctaacccccctaaaccccaaaaccaaacgaccaaacgtaacgccgttaccgccgtaccgcccggacaggttccgttacgggttcgtacgttacgtttcgggtttaaccttccccgtttcaccgtttccctccccgtcctactcgttacgtaaccttcgttaacccg

SEQ ID NO: 342240 - DNA, 575 bp, Homo sapiens
  misc_feature: GZ8MTXP01BRCDE.17.34.D01.1.454.CMB.2.raw
  modified_base (450)..(450): a, c, t, g, unknown or other
  misc_feature (450)..(450): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgccttaggggtcactcaccctgccccgattaaacgttggacaggaacccttggtcttccggcgagcgggtctttcacccgctttatcgttacttatgtcagcaattcgcacttctgactacctccagcatgacctcacagcaacaccttnacagctacagaaccgcctaccctacccaacaaccgcaataacgcgtccgctcgcccgcagcttcggttgccagttcgggtttacnccccgttttnacttccttcccgctatcttcgaacttgtcc

SEQ ID NO: 342241 - DNA, 767 bp, Homo sapiens
  misc_feature: GZ8MTXP01CZTZJ.17.34.D01.1.454.CMB.2.raw
  modified_base (297)..(297): a, c, t, g, unknown or other
  misc_feature (297)..(297): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctgggtgacgggtctccgtgcaaggtcttcgtgggacggcctaccttcgagcgtactattagttacaagttgggngcggacggtcctcgtaggacaaggtccttggaggtggagtgggaagctcgtcctagtcgtagacacaccaaactcccgacacgagtaactccgaagggcaacgactacaaccacgtaaccgacgaaactaaactaaaccgaaacaactaacgttaacgtacgtaggaacgtacgtacgaaaccgtacgtaccgtacgtactacgttacgggtacggtaacgggtaaccgttacccggggttaccctttaacccgttaaccgtttccggttagggtacgggtaaaccgggttaaggttaaacggtttaaacgtttaaaccgtaaacttaaaccgttaaccttacggtttaaccccttttaacccttttttaccccgttaccccttttaccccgtttaacggttaacccgtttccgggttaccggggtacccgttaccggttaacccccgggttaaccccggtttaaccccg

SEQ ID NO: 342242 - DNA, 558 bp, Homo sapiens
  misc_feature: GZ8MTXP01A79VE.17.34.D01.1.454.CMB.2.raw
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
  modified_base (509)..(509): a, c, t, g, unknown or other
  misc_feature (509)..(509): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggncgacgggctctggacaaggccttgagtggatgggaagatcgtccctatcgttgacacaccaaactccgcaacagaattccaaagggcaagactcaaccataaccgcgaacaaataacgaacacaagtaatcagganctagaacagacctgtcatcgtagacggacacgggtcttctacttctagtgacgagtagtaattaactattacacttcgtacttccttttacnccgttcccttaagtacttcgtcggggccttacgtcggaaccccgttccg

SEQ ID NO: 342243 - DNA, 577 bp, Homo sapiens
  misc_feature: GZ8MTXP01BESJ5.17.34.D01.1.454.CMB.2.raw
  modified_base (522)..(522): a, c, t, g, unknown or other
  misc_feature (522)..(522): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggagcaccttcagcgactatagttcaagttgggtgcgacgggcctcgtggacaaggccttgagtggatgggaagatcgtccctatcgttagacacaccaaactaccgcacagaacgttccaagggcaagactcaccataaccgcgaacaaatacgaacacataatctagagctagaacacgcctgtacatcgtaggaggaccgacgggtcttccgtacttctgtgcgtaggtagttaattaactaattaactacttcgtcctttaccttttaccnccctttcccttcgtacttcgtcggggtccagtaaccggttaaccccggtaacccg

SEQ ID NO: 342244 - DNA, 583 bp, Homo sapiens
  misc_feature: GZ8MTXP01DMYKQ.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacggcctctggacaaggccttgagtggatgggaagatcgtccctagtcgttgacacaccaactccgacacagaacgttccaagggcaagactcaacccataaccgcgaacaaattaacgaacacagttaatcgtaggagactagaacacgcctagtcatcgtagacggacgtacgggtctttccgtactttcgtagtgtacgaggtaagtaattaactaattaactacttcgtacttccttttaccttcccttcccttgtaccttcgtcgggccttagtccggttaaccccgtcccg

SEQ ID NO: 342245 - DNA, 583 bp, Homo sapiens
  misc_feature: GZ8MTXP01B2LJ4.17.34.D01.1.454.CMB.2.raw
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctcccgtcccccttgcagtaacaccaagtacaggaatattaacctgtttcccatcgactacgccttcggccncgcttagggcactcaccctgccccattaacgtgacagacctggtctcggngagcggtctttcgaccgtntttactcgttactagtgtcagtcaattcgctacttctgactacctcagcatgcctcacacncaccaccttcaacgagtactaacgagaacccgcctaccccctaacaaaccacgacaagtacgccgtcgctcgccgcagtccgttggcgcttacgttcggttaccgttccccgtttnacttccncccgtctacgtcttcgtaacttaacggtccg

SEQ ID NO: 342246 - DNA, 570 bp, Homo sapiens
  misc_feature: GZ8MTXP01CFX43.17.34.D01.1.454.CMB.2.raw
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggagcaccttcagcgactatagtttcaattgggtgcgacgggcctctggacaaggccttgagtggagtgggaagntcgtccctatcgttgacacactaaactccgacacagaagtccgaagggcaagactcaccataaccgcgaacaaactaacgaacacagtaatctagagctagaacagctgtcatcgtaggacggacgacgggtcttcgtacttcgtgtcgtcgaggtaagtaattaactaattaacacttcgtccttccttttaccgaccttcccttgtaccttcgtcgggtccttacgtccggttaaccccgtcccg

SEQ ID NO: 342247 - DNA, 735 bp, Homo sapiens
  misc_feature: GZ8MTXP01BLCCW.17.34.D01.1.454.CMB.2.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtgagggtctccgtgcgaaggtcttcgtggacggcctaccttcaggacgactagtagttacgaagttgggtgcgacgggcctcgtaggacaaggccttaggagtggagtagggaagactcgtccctagtcgttagaacaacgaaaccaaacgtaccgacaacgaaggtaacgtaccgaaaggggacaacgacctaccgaaacccgtaaacgtaaacccggaacggaaaactaaaacttaaaccgaaactaacgtaagttaaactccgttaagggacgactaacgaaacgtacggtaccctaggtacctaagttccggtaagggaccggaaccgtacgggtactttccgtaacgttccgtaggtaccgacggtaaacggtaaagttaaactttaacgtaaacgttaactaccgttcgtacccttttacccttttaacccgccctttacccgttgttaaccgttcggtacccggggtaccttaaccgggtcccggttaaacccccggttcccg

SEQ ID NO: 342248 - DNA, 616 bp, Homo sapiens
  misc_feature: GZ8MTXP01APU7C.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgcctgggtcctcggtgaggtctcctgcaaggcttgtggagctaccttcagcgtactatagttcaagttgggtgcggacggcctcgtggacaaggccttgagtggagtgggagtatcgtcctagtcgtagacacacaaactaccgctacagacgtccgaagggcaagactacaaccacgtaaccgacgaaacaaacttaaacgaaacactaagtaactcgagggtacactaagaacacgacctgtaccagtcggtaggacggacacgggtcttacgtacttcgagtcgacggtaggtaacttaattaactaattaaacgtcttacgtcctttacctttaacccttccttcccgttgtacctttccggcgggtacccttacggtaacccggttaacccggtaacccg

SEQ ID NO: 342249 - DNA, 549 bp, Homo sapiens
  misc_feature: GZ8MTXP01CO6RA.17.34.D01.1.454.CMB.2.raw
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaagatcgtccctatcgttgacacgaccaaactacccgacacagaagtcccaagggcaagactcacataccgcgacaaatacgacanagtaanctagantagacagcctgtcancgtgaggacacgggcttcgtacttctgtgtcgagagtaattaactattaactacttgtcttccttttaccaccttcccttgtaccttcgtcggggtcttacgtcggaaccccggtcccg

SEQ ID NO: 342250 - DNA, 631 bp, Homo sapiens
  misc_feature: GZ8MTXP01BIFRD.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttggagtggatgggaagatccgtccctatcgttgacacaccaaactcccgcaacgagtaaacgttcccgaagggcaagacctaccaacccaataaccccggacggaaactaaaattaaaccgaacaactaagttaaatcgtaggacgctaagaacacgcctgtctaacgtccgtaggacggacgacgggtcttcgtacgttctggtgcgtaagtagttaataactaattacacgttcgacctttacccttttaccttacccttcccgttaagtaccgtttccggtacggggtcccttacggttccggaacccccgggttcccg

SEQ ID NO: 342251 - DNA, 641 bp, Homo sapiens
  misc_feature: GZ8MTXP01AMIV0.17.34.D01.1.454.CMB.2.raw
  modified_base (305)..(305): a, c, t, g, unknown or other
  misc_feature (305)..(305): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtgagggtctctgcgaaggtcttcgtggacgctaccttcgagcgtacttatagtttcaagttgggtgcggacggcctcgnggacaggtcctggagtggagtagggaagcgtccgtacccttagtccgttagaacctacgaaccaaactacccgacacgaagtacgtccgaagggccaagacctacgaaccctacgtaaccggacgtaaactaaacttaaaccgaactaacgtagttaatcgttaggaactcgtagaacacgccttgactagttcggaggtacggacgtacggttcttacgtaccgttgtacgtgtacggtagtaacgttaataactaacttacgtacttcgtcctttactttaccttcccttccgttaagtcgttcgacgggtccacggtccggttaaccccgtcg

SEQ ID NO: 342252 - DNA, 619 bp, Homo sapiens
  misc_feature: GZ8MTXP01B234T.17.34.D01.1.454.CMB.2.raw
  modified_base (353)..(353): a, c, t, g, unknown or other
  misc_feature (353)..(353): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctcctgcaaggcttcgtggaggcaccttcagcgactatagtttcaagttgggtgcggacggcctctggacaaggccttggagtggagtgggagatcgtccctagtcgtagacacacaaacncgcacagaacgtcgaagggcaagactacaccacgtaaccgacggaaacaaacttaacgaacactaagtaatctaggaagactagaacagacctgtactatcggtagacggtaccgacgggtactttcgtaccttgtaggttgtaggtaaggtaagttaaattaacgtaaattaaactacttcgttacctttacctttttacccttaccttcccgtttaacgtacgttcgtcggggtccttacggtaaccggaaccccgttaacccg

SEQ ID NO: 342253 - DNA, 672 bp, Homo sapiens
  misc_feature: GZ8MTXP01DLP5F.17.34.D01.1.454.CMB.2.raw
  modified_base (286)..(286): a, c, t, g, unknown or other
  misc_feature (286)..(286): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggtcttcgtgggaggccaccttcagcgactatagttcagttgggngcgacgggtcctctggactaggccttggagtggagtgggaagatcgtccctagtcgttagacacaccaaactccgcacagaacgttccgaagggacaacgactacaacccgagtaacccgacggaaacaaataaacgaacaacgtaagttaatcgtaggaacgactaggaacagcctgtactacgtcggtagtacgggaaccgtacgggtcttaccttacgtttcgtacggttggtaccggtaaggtaagttaaacttaacgtaaacttaaaccgtacgttacgttacctttcccctttttaacccgttacccttttacccttcggttacctttccggttccgggtacccgttacgttaacccgggttaacccccggttaaccccg

SEQ ID NO: 342254 - DNA, 595 bp, Homo sapiens
  misc_feature: GZ8MTXP01BNITQ.17.34.D01.1.454.CMB.2.raw
  modified_base (326)..(326): a, c, t, g, unknown or other
  misc_feature (326)..(326): n is a, c, g, or t
  modified_base (386)..(386): a, c, t, g, unknown or other
  misc_feature (386)..(386): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtgggaggcaccttcagcgactatagtttcaattgggtgcgacgggcctcgtggacaaggccttgagtggatgggaagntcgtccctatcgtgacacaccaactccgcacagagtccaagggcaagctcaccataccgngaacaaatacgaacacagtatctgagctagacagcctgtacatcgtagaggtacacggggtcttcgtaccttcgtagttgccggtaaggtagttaaacttaactaacttaaactaaccgttgtacctttccctttttaaccgccctttaccccgttcgtaccgtttcgtcgggggtaccttacggttccgggttaacccccggttcccg

SEQ ID NO: 342255 - DNA, 603 bp, Homo sapiens
  misc_feature: GZ8MTXP01CYSDT.17.34.D01.1.454.CMB.2.raw
  modified_base (332)..(332): a, c, t, g, unknown or other
  misc_feature (332)..(332): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggctctggacaaggccttgagtggatgggaagatcgtccctancgttgacacacaaactaccgcacagaagtccaagggcaagacctcaaccactaaccgcgggaaacaaacttaacgaacaactaagttaatacctagggaagtctagaaacagacctgtacactcgtagacggaacacgggtcttacctacgttctggtgtaccggtaggtaagttaaagttaactaattaactacttcgtcttacccttttaccgccttacccttgtactttccgtcggggtaccttacgttccggaacccccggttcccg

SEQ ID NO: 342256 - DNA, 705 bp, Homo sapiens
  misc_feature: GZ8MTXP01EZ43R.17.34.D01.1.454.CMB.2.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggtttcctctttgtggtggcagcagctacaggtgtccagtcccaggtccagttggtgcaatcgtggggctgaggtgagcgcctgggtcctcggtgagggtctctgcaggcttgtggaggcaccttnagcgactatagtttcagttggngcgacggctgngacaggcttgagtggagtgggaagtctcgtccctagtcgttagaccacgaacccaaactacccgacacgagtaaacgtcccgaagggtacaacgtacctaccaaaccgacgtaaacccggacggaaacctaaaacgttaaaacgaaaccaacgtaaacgtttaaactccgttaggaacggaccttaaggaaacctacgtacccgtaggttactacgtacggtacggaacggtacgaccgggttactttcgtacctttcgtggttacgacggtaaggtaaacgttaacttaactaaacgttaaactccgttacgttccctttaacccttttaccgttccctttaccccgttaacgttacccgtttcgttccgggggtacccttaacggttaacccgggttaaacccccggttcccg

SEQ ID NO: 342257 - DNA, 620 bp, Homo sapiens
  misc_feature: GZ8MTXP01C27ML.17.34.D01.1.454.CMB.2.raw
  modified_base (319)..(319): a, c, t, g, unknown or other
  misc_feature (319)..(319): n is a, c, g, or t
  modified_base (445)..(445): a, c, t, g, unknown or other
  misc_feature (445)..(445): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctctgcaagcttcgtggagcaccttcagcgactatagttcaagttgggtgcgacggctcgtggacaggtcctgagtggagtagggaagngtcgtccctagtcgttagaccaacgaccaaacgtaccgacacgagtaacgttccgaaagggccaagactcaaccaagtaacccgacggaactaaaataaccgaaactaactaagtaatcgtagganacgtagaaacacgccgtagtactactcggttagacggtaccgacggtacttcgtacttcgtgtcgtacgaagtagttaaacttaactaattaactacttcgttacctttcttttaccgcctttacccgtaatacgttcgtcggggccttacgtaaccggttaaccccgttaaccg

SEQ ID NO: 342258 - DNA, 655 bp, Homo sapiens
  misc_feature: GZ8MTXP01CTWAI.17.34.D01.1.454.CMB.2.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtgaagcgccgtggtcctggtgagggtctccngcagtcttcgnggagctacttcagcgactatagttcagttgggngcgacggcctgtggacaaggccttggaggtggagtagggaagtntcgtcctagtcgtanaccaacaccaaactacacanagacgtccgaagggcaagacctcaaccacgtaaccgacgaaacaaactaacgaaacactaagtatcgtaggacgacgtacgaacgacgtactcgtactacgtcggtaacggacgggtaccgtacgggttctttaccgttacgttccgttaggtacggtacggtaaggttaacgttaaacttaaacttaacgttaaacttacgttacgttacccttttaccttttaacccttcccgtttcccttaacggttaccttcggtaccgggtacgttaccggttcccggaaccccggttcccg

SEQ ID NO: 342259 - DNA, 730 bp, Homo sapiens
  misc_feature: GZ8MTXP01CSS2H.17.34.D01.1.454.CMB.2.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgctgggtcctggtgagggtctcctgacaaggcttcgtggagctaccttcgagcgactatagttcaagttgggncgacggcctntggacaaggccttaggagtgggagtaggggaaggtactcggtccctaagcgttagaacacaaccaaactaccgcaacagtaaacgtcgaagggcaagacctacaacccaagtaaccgaggaaaccaaagttaaacaacaactaagtaaactacgtaggaacgacgtaagaaacacgaccgtagtacgtaccttacggtaggaacgggtaaccgaccggggttaacctttccgttaacctttccgttaacgggttggtaaccgggaaacgggtaaactttaaaaggttaaaccttaaagttaaaccgttaaacccttcggttaaccctttaacccttttttaacccgttaccccgtttacccctttaacgttaaaccgtttcccgggttacggggacccttaacggtttaaccccgggaaacccccggtttaacccgg

SEQ ID NO: 342260 - DNA, 826 bp, Homo sapiens
  misc_feature: GZ8MTXP01AT76D.17.34.D01.1.454.CMB.2.raw
  modified_base (205)..(205): a, c, t, g, unknown or other
  misc_feature (205)..(205): n is a, c, g, or t
tcagcgtagactagcacgaccggtgctcgatttagatcgtctgtgttgggtttggggactgatcaggacttctcagttcatcttctcaccatgaggctccctgctcagctccgtggggctgctaatgctctggatacctggatccagtgcagatattgtgatcgacccagacctccactctctctcgtccgtcacaccgtggacncgcccgcctcatcctcctgactaagtctagtcagacgtcctccgtgactagtaggtagggtaagaaacggtaaacgttacctttactttaagttacgtttcggttccctaggaccgaagggaccggaccgaacggtccccgtaacgttcccctaccccgtaacctacccgtttccgtaagttaaacgttttaaaccggtaaacccccgtttttaccccgaaaccgttccgtttacccggaccgttaacgggtaacccttcggaacccgttaaagggttaaacggtttacggggtttacgacggggttcgggaccggacggggtaccggggtacggaaacggggtacctaaggtttaacttttaaaccgacgtttaaacggaaaacgtccgggacggggtaccggggtagggtacgggtacggggttaggggtaaacggggtttacgtttaacgggttaaattttacgttaacgttaggttaagtacggtaaacgtaaaggttacgtaacggttaaccgtccgtttacccgggtaccggttccgggttaaccggaacgggttaaacgggccgaaacgggtaacgaaaccgtaaccgaaacggtacgttacggtcgcgtaacg

SEQ ID NO: 342261 - DNA, 585 bp, Homo sapiens
  misc_feature: GZ8MTXP01DPRUG.17.34.D01.1.454.CMB.2.raw
  modified_base (180)..(180): a, c, t, g, unknown or other
  misc_feature (180)..(180): n is a, c, g, or t
  modified_base (374)..(374): a, c, t, g, unknown or other
  misc_feature (374)..(374): n is a, c, g, or t
  modified_base (510)..(510): a, c, t, g, unknown or other
  misc_feature (510)..(510): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccggacaaccgtcgcccggccaacatagccttctcccgtccccctgcagtaacacaagtacaggaatattaacctgtttccccatcgactacgcctttcggcctcgcctaggggtcactcacctgccccgattacgtggacaggacccttggtcttccggcgagcggtctttcaccgtnttctcttactatgtcagctaattcgctacttctgactacctcagcatcgcctcactgcctaacaccttcacacgtctacacgaaaccctcctaacccctaaccaactaaccgcactaacgcgtaccgctcgccgcngtctcgttgccgttagtttcggttacgttcccgttcttacttcccttcccgcctatccgttattcgaacgttccg

SEQ ID NO: 342262 - DNA, 658 bp, Homo sapiens
  misc_feature: GZ8MTXP01EHMN7.17.34.D01.1.454.CMB.2.raw
tcagcgtagactagcacgaccggtgctcgatttagatcgtctgtgctgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaggcttctggaggccacttcgagcgactatagtcaagttgggtgcgacgggcctcgtggacaaggccttggagtggagtaggggaagtatcccgtccctaagtcgttagacctaacacctaaaaccgtacgacacgaaggtaaccgttacccgaaggggcaaggtacctaccaacccgtaagtaacccgggacggaaactaaaacgttaaaccgaaacaaccgtaagtttaaacgtccgttaagggacgtacgtacggaaacacgctacgtcctaagtcgtagacgggacgtaacgggtcttacgttacttcgtgttcgagaagtaacgtaattacttagtacttactcgtacctttaccttttacaccctttctacgttaacttcggtacgggacctaacggttcccggtaaccccg

SEQ ID NO: 342263 - DNA, 692 bp, Homo sapiens
  misc_feature: GZ8MTXP01C35NP.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacacgccgcctccatctcctgcaagtctagtcagacgcctctgcagtagtggtagaaaggtaaacgtcctttacttattagtttggttccctggacaggacggccaaggcccagtccctaccacctacccttccgtagtaacttttaaccgtaaacgtttcccaaacgtcttcgcgtaggtaacctcggaccctaaaggtaattacggggttaccaagggtcgggaccgaagggtccgggggttaccgaaagggggtaacctaagggttaaacttttaaaccgaacgttaaaggtaaaaacgtcggaacgggcccgggggttagggaagggcgggttagggaacggggttaagtttagggttaaattttagttaacgttgtaactggtaataaggtactaggtaactccgttccgtaccggttacgttaccgggaaccgaaacgggaccaaacgggtaacgtaacaaccgaaacggtagttcgtcgggctaacgg

SEQ ID NO: 342264 - DNA, 619 bp, Homo sapiens
  misc_feature: GZ8MTXP01CNL37.17.34.D01.1.454.CMB.2.raw
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (489)..(489): a, c, t, g, unknown or other
  misc_feature (489)..(489): n is a, c, g, or t
  modified_base (550)..(550): a, c, t, g, unknown or other
  misc_feature (550)..(550): n is a, c, g, or t
  modified_base (570)..(570): a, c, t, g, unknown or other
  misc_feature (570)..(570): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtccccccttgcagtaacaccaagtacagaatattaacctgttcccatcgactacgcctttcggcctcgccttagggtcgactcacccctgccccgattaacgttgactaggacccttggtctccggcgagcggctttcgaccgtntttatcgttacctatgtcagcaattcncactttcagtactacctcagccagttcgccccttagacacgacctaacaccctttcaccgaggccttaaaccagtaaaccccnccttacccccctaaccgaactaaaccgctaactacgcgtacgctacgccgcagtcttcggngacttacgttcgggttcccnccccgtttcaccttcctcccgtctagtccgttacgtaacttcgtaaccg

SEQ ID NO: 342265 - DNA, 729 bp, Homo sapiens
  misc_feature: GZ8MTXP01D2LU9.17.34.D01.1.454.CMB.2.raw
  modified_base (202)..(202): a, c, t, g, unknown or other
  misc_feature (202)..(202): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatcgacccagacctccactctctctcgtcctcacacctggacncgccgcctccatctctgactaagtctaagtcagacgtccctctgactagtaggtaggtaggaaacggtaaaactaccttttactttaattacgtttcgggttaccctggacgaagggacggccccaacgggccctaacgtccccttacccaccttacccttccgttagtaacttttaaccggttaacccgtttccccaaaccggtcctttaccgcgttaacgggaccttggacctaaggtacgttacgggtctagggtcgggacgacggggtcgggtacgaagggactaggttaaacttttaacgacgttaacgtaaacggcgacggggtcccggggtagggacgggtagggggtaacgggtaggggttaacggtttaggttaaattttacgttagttagttagtgtagtaaaggttacgtagtaacgtccttccgtacccggttacggttaccgggaaccgaaacgggttacttaaacggggtaacgtaaaccgaacgttaaaacggcgttaggtcggcgtaaccg

SEQ ID NO: 342266 - DNA, 593 bp, Homo sapiens
  misc_feature: GZ8MTXP01ABYN0.17.34.D01.1.454.CMB.2.raw
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggagcaccttcagcgactatagttcaagttgggtncgacgggcctcgtggacaagtccttgagtggatgggaagntcgtccctatcgttgactacaccaaactccgcacagtaacgtcaagggcaagactcacataaccgngaacaaatacganacagtaanctagagctagaacngcctgacatcgtgagaccgacgggtcttctacttcgtcgtagtcgaaggtattaaacgttaactaattaacctacttcgtacctttaccttttaccgttacccttccccgtttggtaccctttcggtcggggtacccttacggttccggggttaaacccccgttcccg

SEQ ID NO: 342267 - DNA, 721 bp, Homo sapiens
  misc_feature: GZ8MTXP01CTA8Q.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatcgacccagactccactctctctgtccgtcacactggacagcccggcctccgtctcctgactaagtctagtcagcgcctcctgcatagtggtagaaaggaagtaccttcttatagttggttcctgcgagacggccaggccagtctcccacacctcctagtactttacgacgtttacccccaaccgtcttacgctacggtaaaccttcgcccgaagtaacgttcgggttacaagggtcggacgaagggccggggttacgaacggggaacctaaggttaactttaccgaaacgttaaccgttaaaggtaaaaaaccgttcggaacgggggaccccgggggttaggggaacgggtaccgggttaggggtaaaggggttacgtttaagggggttttagggggttttaaaccttacgtaggtaacctaagtttagaaaccgtaaaagttacgtaacgtacgttacccgtttaccgttaacgtttacggttttcgggaaccggttacgggggaaccctaaaggtccgttaagggaaacggtattaacgaaaaccgttaaggttcggg

SEQ ID NO: 342268 - DNA, 644 bp, Homo sapiens
  misc_feature: GZ8MTXP01AR1EF.17.34.D01.1.454.CMB.2.raw
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (461)..(461): a, c, t, g, unknown or other
  misc_feature (461)..(461): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggcaacatagccttctccgtcccctgcagtaacacaagtacagaatataacctgttccatcgactacgcttcggctcgcttagggcactcacctgccatacgtgacnggacctgctcggcgagcggtctttcnccgtcttatcgttacctatcgtacacgtctaattcgctacttctagactaccgtcagccatcgcctcacacgacaacctaccttacacgacggtaccttaacgaacgaaacccncccgtaaccccctaaacccaaccaaaccgacctaaactaaacggtccgtccggccttcgggccccgacgtacggtccgttcggcgtacgttacggtttaccgggtttacccgttccccgtttcttacccgtttccccgtccccgtaacctaccgttccgttacgtaaccgttaaccgtaaccg

SEQ ID NO: 342269 - DNA, 644 bp, Homo sapiens
  misc_feature: GZ8MTXP01ECPOW.17.34.D01.1.454.CMB.2.raw
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (506)..(506): a, c, t, g, unknown or other
  misc_feature (506)..(506): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggttctctgcaaggtcttcgtggaggcaccttcagcgactatagttcaagttgggngcgacggcctcgtggacaggcttgagtggatgggaagntcgtccctagtcgtnacacaaccaactccgcagagaacgtccgaagggcaagtactaccaaccacgtaacccgacggaaactaaaacttaacgaaactactaagttaactcgtaggacgctacgaaacagcctagtactacgtcggtaggaacggaccgacgggttcttacgtacgtttcgnggtcgtacggtaagtaagttaacttaacttaattaacgtcttcgtacccttttaacccttttaaccgttcccctttcccgttaagtacccgtttcggttccgggggaccttacggtcccgggttaacccccggttccg

SEQ ID NO: 342270 - DNA, 687 bp, Homo sapiens
  misc_feature: GZ8MTXP01B1LXA.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctccgtggggctgctaatgctctggatacctggatccagtgcagtatattgtgatcgacccagactccactctctcgtcgtccgtcacaccgtggacacgccgcctcatctcctgactagtctagtcagcgtcctctgactagtaggtaggtaagaaaggtaaacttcctttacttagttacgtttcggtctcgacgagggacggaccgacggtcctacgtccctaccacctaccttaccgtagttacgtttaaccgtaacccgttcccaacgtcgtacgcgtaacgactcgacctagtacgtacggttcaggtcggaccgagggtcggtacggaacggtacgtaagttaacgtttaacgaacgtaagtaaacgtcggacgggtacggggtaggaccggtacgggtagggtaagggttacgttaaggtttaatttaacgttagtaggttaagtcgttaaagtaaggttacgtaggtaacgttccgtttccggtaccgttacggttaccggaacggttaacgggacgttaacgggttaacgaaaccttaacggaacgtacgttcggtaacgttcgtaacg

SEQ ID NO: 342271 - DNA, 699 bp, Homo sapiens
  misc_feature: GZ8MTXP01D5WP5.17.34.D01.1.454.CMB.2.raw
  modified_base (262)..(262): a, c, t, g, unknown or other
  misc_feature (262)..(262): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctccgtgcaaggcttcgtggaggcaccttnagcgactatagttcaagttgggtgcgacgggcctcgtggacaaggtccttaggagtgggagttgggggaaaggtacttcggtcccctaagtccgttagaccaacgaacccaaactaccgacaacgagtaacgttcccgaaaggggctaagacctaccaacccaagtaaccccggacggaaactaaaattaaacccgaaactaaacctaaggttaaactcgttaggaacgtacgtaacgaaaccgaagtccctaggtacctagttaccgtaggaacgggtaccaacgggttcttacgttacttcgtggtcgtacgtaggtaagttaacttaaacctaagttaaacgtacttacgtccctttccttttaaccgttccccttacccgttgtaccgttccggtcggggacccttacgtcccgggaacccccggttaacccg

SEQ ID NO: 342272 - DNA, 569 bp, Homo sapiens
  misc_feature: GZ8MTXP01DR8AV.17.34.D01.1.454.CMB.2.raw
  modified_base (351)..(351): a, c, t, g, unknown or other
  misc_feature (351)..(351): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggcaacatagccttctccgtcccccttgcagtaacacaagtacagaatattaacctgttcccatcgactacgcctttcggcctcgcttagggtcactcaccctgcccgattaacgtgacaggacccttggtctcggngagcggtctttcgaccgtgttatcgttactatgtcagcaattcgctacttcagactacctcacgcatcnctcacanacactactacgacacgactacaacgaccnccctaccccaaaccaacgaacncaagtacgcgtcnctcgcgcncgtcgtcgttcgtcgttacgttcgttcgttcccgttccttcttcctccgtcctctcttactcgttcgtcg

SEQ ID NO: 342273 - DNA, 554 bp, Homo sapiens
  misc_feature: GZ8MTXP01BUMLV.17.34.D01.1.454.CMB.2.raw
  modified_base (325)..(325): a, c, t, g, unknown or other
  misc_feature (325)..(325): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacgggcctcgtggacaaggccttgagtggatgggaagntcgtccctatcgtgacacacaaactaccgcacagacgttcccaagggcaagactacaccataacccgaggaacaaattaacgaacactagttaatctggagctagaacagcctgacaatcgtagacggacacgggtcttcgtacttgtgtgtcgaggtataataactattacncgttcgtacttcctttacgccttcctntactcgtcgggcttacgtccgaacccgtc

SEQ ID NO: 342274 - DNA, 734 bp, Homo sapiens
  misc_feature: GZ8MTXP01BSFXD.17.34.D01.1.454.CMB.2.raw
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgacaatcgtggggctggaggtagaacgaccgccgtgggtccgtggtgacggtcctccgtgacgagtcttcgtggacgctaccttcagcgtactagttagttacagttggcgacggaccggtcctcgtacggaacgacggtcgttggaggtaggagtagggaaagtcttccgtccctagttccgttacgaacctaaccgaaccaaacgtacccgaccaacgtaagaaccgttacccgaacgggtacaacgtaccctaaccgaacccgtaaacgtaacccggaacggtaaactaaaacgttaaaccgaaacgtaaccgttaaagttaaccgttacgttaacggtaacgtacgttaacgaaccgacgtaccgtacgtactacgttcggtaggaacggtaccgtaccgggttctttaccgtacgttcgttggtcgtacggtagtaagttaacttaactaattacgtacttcgtacctttacctttacccttcctttcccgttaagtaccttcggtccgggtacttaccggttaacccggttaacccgttcccg

SEQ ID NO: 342275 - DNA, 564 bp, Homo sapiens
  misc_feature: GZ8MTXP01DZYV5.17.34.D01.1.454.CMB.2.raw
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (427)..(428): a, c, t, g, unknown or other
  misc_feature (427)..(428): n is a, c, g, or t
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgatttttccggatttgcctaggaaaaccagcctacacgcttaaaccgggacaaccgtcgcccggcaacatagccttctccgtcccccttgcagtaacaccaagtacagaatattaacctgttcccatcgactacgccttcggcctcgctagggtcactcacctgcccgattaacgtgacaggaccctggctcggngagtcggtctttcacccgtntttatcgttactatgtcagcaattcgctactttcagactacccncagcatcgcctcacnncactaccttcacagtacttacaacgacctcctacccctaacaacacgnaactagctacgctgccgcagtcttcgggncttagttcggttaccnccccgttnttccaacttcctcccgctagttctgaacgttaacg

SEQ ID NO: 342276 - DNA, 554 bp, Homo sapiens
  misc_feature: GZ8MTXP01DPSTE.17.34.D01.1.454.CMB.2.raw
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (388)..(388): a, c, t, g, unknown or other
  misc_feature (388)..(388): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaagntcgtccctatcgttnacacacaaactcgcacagaacgtccaagggcaagactcaaccataaccgngaacaaattaacaacacagtaatctagagctagaacagcctgtacatcgtagaggacacgggtcttctacttctagtgacgaggtataattaactattaacncttgtctttccttttacnccttcccttgtacttcgtgggccttagtccggttaaccccgttccg

SEQ ID NO: 342277 - DNA, 643 bp, Homo sapiens
  misc_feature: GZ8MTXP01BD6FT.17.34.D01.1.454.CMB.2.raw
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtcgcggacgggccttcgtggacaaggtccttggagtggatggggaagntcgtccctatcgtgacacaccaaactccgcanagaagtccaagggcaagactcacataccgacgacaaataacgacacattaatcnggacnctagaacagcctgtcatcgtagaggacctacggggtcttacgttacttcgtgtaggtccggtaagggtaagttaaactttaactaaacgttaaaccgtactttacggttacccttttacctttttaaaccccgttccccttttacccgtttaaccgttaccgtttcccggttaccgggggtacccttaaccggttaacccggggttaaaccccccgttccccg

SEQ ID NO: 342278 - DNA, 753 bp, Homo sapiens
  misc_feature: GZ8MTXP01CWGO9.17.34.D01.1.454.CMB.2.raw
  modified_base (284)..(284): a, c, t, g, unknown or other
  misc_feature (284)..(284): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtgagggtctctgcaggcttcgtggagcaccttcagcgtactattagttcaagttgggngcgacggctcgtggacaaggccttgagtggagtgggaagtctcgtaccctagcgttagaactacgaacctaaactacccgacaacgagtaacgttccgaacgggactaacgacctacaaccgtaacgtaacccggacggtaaactaaaacttaaaccgaaactaacgtaaacgttaaagtccgttagggaacgtacgttaacgaaacgtacggtaccccttagtaccgtagttacggttacgggaaacggtaccggttacccggggttcctttaaccgttaaccgtttcggtaccggtgggtaccgtaaacggggttaaatttaaacggttaacgtaaacttaaacccggttacttcggtttaaccccttttactttttaaaccccgttcccttttacccgttaagttcccggttcggttacgggggacccttacgggttaaccccggttaaccccggggttaaccccg

SEQ ID NO: 342279 - DNA, 781 bp, Homo sapiens
  misc_feature: GZ8MTXP01EF3W9.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctccgtgcgtaaggtcttcgtagggaggcctaccttcgaggcgtacttattagttacaagttgggtcgcggacgggtcctgtaggaacaggtccttgaagtgggatagggaagtactcggtaccctagtcgttagaacctacaaccaaactcccgactaacagaacgttcccgaagggtaccaaggacctacaaacccgtaactaacccggacggaaaactaaacgttaaaccgaaactaactaacgttaaactaccgtagggtaacgtacgttacgaaacgacgtacccgtagtactaacgttacggtacggaacggtaaccgtaccgggtactttaccgttaccttcggttagtacggtaaccggtaagggttaacgttaaacttaacgttaacgttaaaccgttacctttacggtacccctttttaacccgtttttaacccgttacccctttacccgttttaaccggggtaaacccttttccggggtaccgggggtaccccttaaccgggttaaccccggggttaaaccccccgtttaaccccgg

SEQ ID NO: 342280 - DNA, 618 bp, Homo sapiens
  misc_feature: GZ8MTXP01CFJFX.17.34.D01.1.454.CMB.2.raw
  modified_base (572)..(572): a, c, t, g, unknown or other
  misc_feature (572)..(572): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttcgtggaggccaccttcagcgactatagttcaagttgggtgcgacgggcctcgtggacaaggccttggagtggagtagggggaaggtactccgtcccttagtccgttagaccacaaccaaactaccgaccacgagtaacgtccgaagggcaacgactacgacccacgtaacccgacggaaactaaacttaaccgaacaactaagttaactcgtaggacgactagaacgacgcctgtacagtcggtgacggtaccgacgggtcttccgttacttcgtcggtcgacgtaaggtagttaattaactattactacttcgtacttccttttacncccttccttcgtacttcgtcgggccttacgtccggaaccccgtccg

SEQ ID NO: 342281 - DNA, 730 bp, Homo sapiens
  misc_feature: GZ8MTXP01CMP53.17.34.D01.1.454.CMB.2.raw
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcgggtgagggtctcctgcaaggcttcgtggaggcaccttcagcgactagtagttcaagttgggtncggacggcctcgtggacaaggccttgagtggatgggagntcgtcctatcgtagacacacaactccgcacagactccgaagggcaagactacacaagtaacccgacgaaacaaaacttaacgaacaacgtaagttaactaccgtagggacgtaccgtaacgaaaccgtagtaccccgtgtacctaacgttacgggttacggaaacggggtaccgtacccggggtacctttacccgtactttacgtcggttaacggaccggtaacgggtaaatttaacgtttaaaccgttaaattaaaccccgttacgttacccggtttaccctttttaaccccgttttttaacccgccccttttacccccgggttttaacgtacccgttttaaccggtcccgggggttaccccttaaccgggttccccggggttaaaaccccccgggtttccccg

SEQ ID NO: 342282 - DNA, 684 bp, Homo sapiens
  misc_feature: GZ8MTXP01CMRC7.17.34.D01.1.454.CMB.2.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (400)..(400): a, c, t, g, unknown or other
  misc_feature (400)..(400): n is a, c, g, or t
tcagcgtagactagcacgaccggtgctcgatttagatcgtctgtgttgggtttggggatcaacaaaaacaaccagattcctcctctaaagaagcccctgggagcacagctcatcaccatggactggacctggaggttcctctttgtggtggcagcagctacaggtgtccagtcccaggtccagttggtgcatcgngggctggaggtgaagacgcctgggtcctcgggtgagggtctccgtgacgaaggtccttcgngggacgctaccttcagcgactatagttcaagttgggtgcgacggctgtggacaaggccttgagtggatgggaagngtcgtcctatcgtnacacacaactacgcanagacgtcgaaggcaagactcaacacgtaaccgacggaanaaaacgttaacgaaacaacgtaagtaaatccgtaggaacgtactaagaacgacgacccgttagtacctaagttaccgggtaaggaaccggggtaacgtaacccggggttcctttaccgttaaccgtttcgtacggttaggaccggtaaggtaaacgtttaaacttaaacttaacttaaacctacttacgttaaccttttccctttttaaccttcccgtttacccttaacgtactttcccggtacgggaccttacggttaaccccggttaaaccccgtttccccg

SEQ ID NO: 342283 - DNA, 731 bp, Homo sapiens
  misc_feature: GZ8MTXP01A6929.17.34.D01.1.454.CMB.2.raw
  modified_base (460)..(460): a, c, t, g, unknown or other
  misc_feature (460)..(460): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgccgtgggtcctcgggtgacgggtctcctgcaaggcttcgtggaggcctaccttcagcgtactatagttcaagttgggcgcgacgggcctcgtaggacaaggccttggacgtgggagtgggaagatccgtaccctagtcgtagacctacaaccaactaccgacacgacgtaagttcccgaaagggacaacgtaccgtcaaccctaagtacccggacgaactaaaacttaacgactaaacgtagttaacncgtaggatacgtagaacacgcttagtaccacgttcgggtaggaacggtaaccgtaccggggttcctttaccgttaaccgttcgtacgtaggtaccggtaaggttaaacgtaaacgtttaactaaacggtttaaaccctaccggtttacggttaccccttttaaccctttttaaacccgaccccgttttaccccgttaacggtttaaccctttccggggtccgggggtaccccttacggtttaaccccggggttaaaccccccgtttcccgg

SEQ ID NO: 342284 - DNA, 637 bp, Homo sapiens
  misc_feature: GZ8MTXP01BB4Z1.17.34.D01.1.454.CMB.2.raw
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctggtgaggtctctgcaggcttcgnggagctaccttnagcgtactatagttcagttggtgcgacggctgnggacaggctgagtggagtggagntcgtcctntcgtanacacaacaactcgacacagtacgtcgaaggcaagacacaaccaacgtaaccggacgaaactaaacgttaaacaaactaaactaagttaaactccgtaaggaacgtacgtaacgaactcgacctgtactagtcgtaggaacgggactaccgggttcttacgtacgtttcgtcggtagtacggtaagtacgttaaacttaactaattaaaccgtcttcgttacctttccgttttaacccttccttacccgtttaagtacccgtttcgggtaccgggtcttaacccggttcccggttaacccccggttcccg

SEQ ID NO: 342285 - DNA, 662 bp, Homo sapiens
  misc_feature: GZ8MTXP01AQYJ5.17.34.D01.1.454.CMB.2.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacgaggtgtccagtcccaggtccagttggtgcaatcgtgggctgaggtgaagcgcgtgggtcctcggtgaggtctcngcagcttnggagcaccttnagtctactatagttcagttggtgcggacggtctgnggacaggtctggngtggagngggagactcgtctatcgtanacacactaacncgacagagacgtcgaaggcaacgactaccaccacgtaaccggacgtaaacaaaactaacaactactaacgttaactcgaaggtagaccgtagaaccgacgacccgttagtacctaacgccggttagggaacgggtaccgtaaccggggttcctttaccgttaacgttcgtggttacgggcgtaaagggtaacttaacttaactaaacttaaacgtcccgttaccgttaccttttaccccttttacccttcccctttcccgttaacggttacctcgggtacccggggtccttaccgggtaaccccggttaaccccgttaacccg

SEQ ID NO: 342286 - DNA, 731 bp, Homo sapiens
  misc_feature: GZ8MTXP01EUXA3.17.34.D01.1.454.CMB.2.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgctgggtcctggtgagggtctccgtgcaaggtcttcgtgggacgccaccttcagcactatagtttcaagttgggngcggacgggcctcgtaggacaggtccttgagtggagtggaagctcgtccctatcgtnacacacaactccgcacagaactccgaaggcaagacctacaaccacgtaaaccggcggaaactaaaacgtaaaccgaaactaactaagttaactacgtacggtaactccgttaacgaaaccgacggtcccctagtacgtaaccgttacggggtaaggtaaccggggtaaaccgtccgggttacctttaccgttaacgttccgttagggtacggtaaccgggtaaacgttaaagttaaactttaaaccgttaaacgttaaaccctacgtttacgtacccctttttaacccttttacccgttaccccgttttacccgttaacgttacccggtttccggtaccgggggtacccttaaccgggtaaccccggttaacccccgggttaaccccg

SEQ ID NO: 342287 - DNA, 669 bp, Homo sapiens
  misc_feature: GZ8MTXP01A23RJ.17.34.D01.1.454.CMB.2.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (458)..(458): a, c, t, g, unknown or other
  misc_feature (458)..(458): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctgggtgacgggtctccgtgcgaaggtcttcgtgggacggtcctaccttcgagtcgtaacttagtagtttacaagttgggcgcggacgggtcctgtaggacaaggtccttaggaggtggagtagggaagtctcgtcctagtcgtanacacacaacnccananagtactcgaaggcaagactacaaccacgtaaccgacgaaacaaactaacgaacaactaagtaactcgtaggaacncgtaacgaacacgtcctagtactacgtcgtacggaacggtaccgacggttcctttactacgttcgtacggtcgtagggtaacgttaaagttaaactaactaaacttactacgttcgttaccctttaacccgttttaccttccccgtttaccttaacggttaccctttcgggtaccgggtaccttaacgggtccccggttaacccgttcccg

SEQ ID NO: 342288 - DNA, 686 bp, Homo sapiens
  misc_feature: GZ8MTXP01ATPHZ.17.34.D01.1.454.CMB.2.raw
  modified_base (279)..(279): a, c, t, g, unknown or other
  misc_feature (279)..(279): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctggtgaggtctcgtgcagcttcgtggagcacttcagcgactatagttcagttgggncggacggctcgtggacaggtcctggagtggagtaggggaagctccgtcctagtcgttacgacaccaacaacgtaccgacaagacgaagtcccgaagggacaagacctacgaaacccgaacgtaacccggacggaaactaaacgttaaaccgaaactaacgtaagttaactacgtaggacgacgtaacgaaccgacgtcctagtactacgtacggtacgaacggggtaccgtacgggtctttccgtacgtttcggtaggtacggtaccggtaaggtaaacgttaagttaacttaaacgttaacttaccgttacgttaccctttacccgttttaccacccgtttcccgttaacgttccgttccggtacggtacccttacggttaacccggttaaccccggttaaccccg

SEQ ID NO: 342289 - DNA, 578 bp, Homo sapiens
  misc_feature: GZ8MTXP01EZX9M.17.34.D01.1.454.CMB.2.raw
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (536)..(536): a, c, t, g, unknown or other
  misc_feature (536)..(536): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggagcaccttcagcgactatagtttcaattgggtgcgacgggcctntggacaaggccttgagtggattggaagntcgtccctatcgtgacacaccaaactaccgcacagaagtccaaagggcaagactacaaccataaaccgcggaacaaaacttaacgaaacactaagttaatcgtaggaacactagaacagcctagtacaattcgtagacggacgtacgggtcttctacttcgtgtcgacgaagattaagttaactaattaaacctattcgtccttaccttttacnccttccttgactttcggcgggccagtccggttaaccccgtcg

SEQ ID NO: 342290 - DNA, 627 bp, Homo sapiens
  misc_feature: GZ8MTXP01EH5LM.17.34.D01.1.454.CMB.2.raw
  modified_base (257)..(257): a, c, t, g, unknown or other
  misc_feature (257)..(257): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtagaagcgccgtgggtcctggtgaggtctctgcagcttgtggagctaccttnagcgactatagttcagttgggtgcgacggcctgtggactaggctggagtggagtgggaagatcgtccctatcgtgacacaaccaactcncanagtacgtccgaaggcaagactacaaccgaactaaccggacggaaactaaaacgtaaacaactaaccgtaagttaactccggtaggaactacgtaagaacgtcgacctagtacctaagtcggggtaaggaccggtacgtaccggttcctttactctttcggagtcgtaacggtaaggtattaaataactattaaacgtcttcgttaccctttacttacccttaccttccgttcgtacgttccggtgggtacccacggttaacccggttaacccgttccc

SEQ ID NO: 342291 - DNA, 673 bp, Homo sapiens
  misc_feature: GZ8MTXP01BJQFC.17.34.D01.1.454.CMB.2.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctggtgaggtctctgcaggcttgtggagctaccttnagcgactatagttcaagttgggtncggacggcctcgnggacaaggccttgagtggagtgggaagntcgtccctatcgtagacacaaccaaactccgacacgagaacgtccgaagggacngacctcaaccactaaccggacgaaactaaactaacgaaactactaaggtaactacgtaggaacgtacgtaagaaaccgacgacccgttacggtactaacgtacggttaacgggaaacggggtaccgtaccggggttacctttaccgtaaccgtttcggtacggttgaccgggtaaaggtacgttaaataaccttaaagttaacctacgttcgttacctttacccttttaccgaccctttcccgttaagtaccgttcggtacgggtccttacgtaacccggttaacccggttaaccccg

SEQ ID NO: 342292 - DNA, 883 bp, Homo sapiens
  misc_feature: GZ8MTXP01D9JFE.17.34.D01.1.454.CMB.2.raw
  modified_base (139)..(139): a, c, t, g, unknown or other
  misc_feature (139)..(139): n is a, c, g, or t
  modified_base (252)..(252): a, c, t, g, unknown or other
  misc_feature (252)..(252): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctnttttgtggtggcagcagctacaggtgtccagtcccaggtccagttggtgcaagtcgtggggctggaggtgaagcgcgtgggtcctggtgaggtctccgtgacgagtcttacgnggaggtcctaccttcaggtcgaacttagttacgtttacgtaaggttcggggcggtccgggtaaccgggtccttcggttaacgggaaccgtaacggggttacccgtttaggggagggtttacgggggaacggttaggggggaaaacggttcgtttacccggtttaaccccctttaggttaccggttaacggtaaacccctaaacccgaaacccgtaaaaaccgttacccccggaccaaaacgtaaacgggtaaccgtttacccgggaaacgggaacctaacggtaaccctaaccgaaaaccccgtaacggttaaaccccggaacggggtaaaactaaaaaaccgtttaaccgaaactaaaccgttaaaggtttaaaacgtcggtaaacgggggtaaactcccgttaaaggaaaccgacggttaccttaacggtacctaacgttacggggtacgggaacgggtaacccgtacgggtttaccttccgttaacgttccgtacgggtagtaacgttaagggttaaacttaacttaacgttaacttaaccgttcttcgtttaccctttaacccttttaccgcccttcgttaactcggttaacgaccggtacttaccggtaaccccgttaacccgtcc

SEQ ID NO: 342293 - DNA, 836 bp, Homo sapiens
  misc_feature: GZ8MTXP01A9SNX.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcgtgggtcctggtgagggtctcctgcaaggtcttcgtggaggcctaccttcgagtcgactattagttcaagtgggtacgcggacggtcctcgtacggacgaggtccgttgaacggtgggacgtaggggaagtacgttccgtacccgtagtcgttgaactacaaccaactaccgacacgaagaactccgaaggcaacgactcaaacctactaaccggaacgaactaaaacgtaaccgaaacgtaacgtaacgttaactaccgttaggaacgtaccgttaaacgggaacctaccggtaccgttcggtaactaacggtttaccgaacgggggttaacgtaacccggggtacccgggtttaaaccctttccgtttaaaccgtttccggtttaaggggtacgggttaaacccggggttacgggtttaaaaggtttaaaacttaaacccggtttaaacttaaacccggtttaaccctttagggttttaacccccgtttttaacccctttttaaccccggttccccttttaccccggttttaaccggttacccgttttaaccggggtaaccccggggttcccgttaaccccgggtttaaccccgggttaaaccccccgggggtttccccc

SEQ ID NO: 342294 - DNA, 800 bp, Homo sapiens
  misc_feature: GZ8MTXP01EYLFA.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggagttcctctttgtggtggcagcagctacaggtgtccagtcccaggtccagttggtgcaatcgtggggctggaggtgaagacgccgtgggtcctcggtgagggtctccgtgacgaaggtcttcgtgggacggtcctaccgtttcgaggtaccgtaacttaattacgttttacgaaagtttcgggggtacggtccggaaccgggtcccttacgtacgggaacgaaacggtccttagggaggtagggagtaggggaaacgtacgtccgtacccttagtccgttagaaccaaccaaaccaaactacccgacaaacgagtaaacgttcccgaaacgggactaacggacctaccgaaccctaacgtaaacccggacggaaactaaaacgttaacgaaactaacgtaagttaactaccgtaggactagttacgaaacgtgttacctagtacctagttacggaggtaaacggtaccgtacgggttacctttacgttaacccgttcgttacgggtacgtaacgggtaaggttaaagttaaaccttaattaaacggttaaaccctacgtttaccggttacccttttaacccgttttaacccttcccggtttaccctttaacggtacgtttcccggtacggggtacccttacggttaaccccgggttaacccccgttcccg

SEQ ID NO: 342295 - DNA, 721 bp, Homo sapiens
  misc_feature: GZ8MTXP01EZ4YM.17.34.D01.1.454.CMB.2.raw
  modified_base (139)..(139): a, c, t, g, unknown or other
  misc_feature (139)..(139): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (462)..(462): a, c, t, g, unknown or other
  misc_feature (462)..(462): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctntttgtggtggcagcagctacaggtgtccagtcccaggtccagttggtgcaatcgtgggctgaggtgaagacgcctggtcctcggtgacgggtctccgtgcaggcttcgtggagcaccttnagcgactatagttcaattgggncgacggtctctggacaaggcctggagtgaggtaggagtcgtccgtaccttagttcgtacgtaacaacctaaactaacgtccgacaacgaagtaacgccgaaggacaacgtacctacaaccgtaacgaaccggtacgaaactaaacgtaaacaactaacgttaacgttaatccggagaacgngtaacgaacgtctacgtagttcgaacttcgggtaggtaaccggtaccgtaacgggttccttaccgttacgtttcgtcggtaggtaaccggttaagtaaaccgttaaattaaacgttaaaccttaaccggtacttacccgtttaacccgttttacccctttaaccccgtttcccgtttaccccttaacgggttcccgtttaaccggggtccggtaaccccgttaggggttaaccccccggttaacccgtttaacccccgg

SEQ ID NO: 342296 - DNA, 640 bp, Homo sapiens
  misc_feature: GZ8MTXP01EKXSC.17.34.D01.1.454.CMB.2.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctggtgagggtctcctgcaggtcttcgtggagcaccttcagcgactatagttcaagttgggtgcgacggcctcgtggacaaggcctgagtggagtgggaagntcgtccctatcgtgacacaccaaactccgcacagacgtccgaagggacaagactacaaccacgtaaacccgacggaaactaaaagttaaaccgaaactaactaagtaactacgtaggaacgtactaggaacacgaccgtgtacagtcgtaggaacggaccgtacgggtccttaccgttacgttcgttaggtcgtacgtaaggtaacttaaagttaactaacttaaactacgttcgttacctttacccttttaccgccctttcccttaacgtaccgttcggtacgggtaccgacggtcccggttaacccgttaaccccg

SEQ ID NO: 342297 - DNA, 798 bp, Homo sapiens
  misc_feature: GZ8MTXP01EH1OQ.17.34.D01.1.454.CMB.2.raw
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgaggtctcctgcagtcttcgtggagcaccttcagcgactatagttcaagttgggngtcggacggtcctcgtggacaaggccttgagtggagtggaagtntcgtccctatcgtagacacgaaccaaactcgcacgagtaacgttccgaaagggcaagactaccaaaccctaagtaaccccgacggtaaactaaaacttaaaccgaaactacgtaaaggttaaactacgttagggaaacgtacgttaacggaaaaccgacgtaccgttacggtaccgtaacggttaccggggttaaggggaaaccggggtaacccgggttaccggggttacccttttaacccgtttacggtttaccggttaacgggtacgggttaaccgggtaaacgggtttaaacgtttaaactttaaaacctttaaacgttaaacccgttaccgtttaaccgtttaccccttttttaaccccgttttaaccccgttccccgttttacccgtttaaccggtttacccggtttccgggttacccgggtacccgttaacccgggtttaaccccgggttaacccccggtaacccg

SEQ ID NO: 342298 - DNA, 690 bp, Homo sapiens
  misc_feature: GZ8MTXP01CTSPM.17.34.D01.1.454.CMB.2.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (621)..(621): a, c, t, g, unknown or other
  misc_feature (621)..(621): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctactggtgtccagtcccaggtccagttggtgcaatcgtggggctggaggtgaagacgcctgggtcctcgggtgagggtctccgtgcaaggtcttcgtggaggacaccttcagcgactatagttcaagttgggngcgacggcctcnggacaggcttggagtggagtgggaagtctcgtcctatcgttagaccaacaaccaaactaccgacaacgagtaacgttccgaaagggccaaggacctacgaaacccaacgtaaaccggacggaaactaaaaacgttaaacgaaactaacgtaaagttaaactacgtagggaacgtactagaaaccacgtaccgtgttacaagttcggtaggaacggtaacgtaccgggtactttaccgtactttcgtaggtacgtacggtaaggtaagttaaatttaactaaagttaaaccttacgttcgttaccctttcctttttaaccncccgtttaccctttcgtaccgttccggttacggggccttaaccggtcccgggttaaccccgttaacccg

SEQ ID NO: 342299 - DNA, 552 bp, Homo sapiens
  misc_feature: GZ8MTXP02JXU0F.17.34.D01.1.454.CMB.2.raw
  modified_base (507)..(507): a, c, t, g, unknown or other
  misc_feature (507)..(507): n is a, c, g, or t
  modified_base (529)..(529): a, c, t, g, unknown or other
  misc_feature (529)..(529): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcgactcaccctgccccgattaacgttggacaggaacccttggtcttccggcgagcgggcttttcacccgctttatcgttacctatgtcagcatttgcacttctgatacctccagcatgcctcacagcacaccttcataggcttacagaacgctcccctaccaacacgcataagcgtcgctgccgcagcttcggngcatcggtttacgccccgtttnactcttcccgcatctgactagtc

SEQ ID NO: 342300 - DNA, 545 bp, Homo sapiens
  misc_feature: GZ8MTXP02HY1A3.17.34.D01.1.454.CMB.2.raw
  modified_base (339)..(339): a, c, t, g, unknown or other
  misc_feature (339)..(339): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtgatggaaagacctattgtattggtacctgcagaagccaggccagcctccacaggtcctgatctatgtaagtttcccaaccggttctcgtgggngtgccagatagggttcaggttggcgaggcgggtacgagggacagtatttcaacacgtagaaaactcgaaggccggggtgggaggtcgtaggagggtagttggtttaggggtttatttacgtgtactagtgaacgtaaagtatacacgtcttaccgtactacgtttcggaccgtaacgggtacaacgcgtaggacgactacaaacgg

SEQ ID NO: 342301 - DNA, 545 bp, Homo sapiens
  misc_feature: GZ8MTXP02GWYF7.17.34.D01.1.454.CMB.2.raw
  modified_base (421)..(421): a, c, t, g, unknown or other
  misc_feature (421)..(421): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactaccgcacagaagttccagggcagactcaccataacccgcggaacaaattaacgaacacagttaatctagganctagaaacagcctgtacatctgagacacgggcttctactctgtcgcgaggagtaattactataacactcgacttcctttacaccttccctgtacttcgtcgggcctacgtcggaaccccggtcc

SEQ ID NO: 342302 - DNA, 585 bp, Homo sapiens
  misc_feature: GZ8MTXP02IR00M.17.34.D01.1.454.CMB.2.raw
  modified_base (467)..(467): a, c, t, g, unknown or other
  misc_feature (467)..(467): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgcccccgattaacgtggacaggaaccccttggtcttccggcgagcgggctttcgacccgcttatcgttaccttatgtcagcattcgcacttctgactacctcagcatgcctcacagcacaccttcacaggcttacagaaccncctacccctaccaacacgacatacgcgtcgctcgccgcacgtcgttcggtgactagttcggttaccgccccgtcttcctaacgttcccttccccgtcctacttccgtacgtacttacg

SEQ ID NO: 342303 - DNA, 586 bp, Homo sapiens
  misc_feature: GZ8MTXP02HFI6S.17.34.D01.1.454.CMB.2.raw
  modified_base (415)..(415): a, c, t, g, unknown or other
  misc_feature (415)..(415): n is a, c, g, or t
  modified_base (546)..(546): a, c, t, g, unknown or other
  misc_feature (546)..(546): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgccttagggtcactcaccctgccccgattaacgtggacaggaacccttggtcttccggcgagcgggcttttcacccgtctttatcgttaccttatgtcagcattcgctacttcngataccctccagcatgcctcacagcacacccttcacaggcttacagaaaccgcctaccccctaccaacaacgccaataacgcgtcgctcgccgcacgtcttccggtgccagttcggtttacgcccccgttnttccaacgttcccttccccgacctactcctacgtactacg

SEQ ID NO: 342304 - DNA, 563 bp, Homo sapiens
  misc_feature: GZ8MTXP02I2XB7.17.34.D01.1.454.CMB.2.raw
  modified_base (534)..(534): a, c, t, g, unknown or other
  misc_feature (534)..(534): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgcctttcggcctcgccttaggggtcgactcaccctgcccccgattaacgtggacaggaacccttggtcttccggcgacgcgggcttttcacccgtcttatcgttaccttatgtcagcattcgctacttctgatacctccagcatgcctcacagcacaccttcacagcttacagaaccgctccctacccaacacgccataagcgtcgctgccgcacgcttcggtgcatcggtttacgcccccgtttnacttccgtcccgctactctcgactacgtc

SEQ ID NO: 342305 - DNA, 537 bp, Homo sapiens
  misc_feature: GZ8MTXP02F8HEH.17.34.D01.1.454.CMB.2.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagntcgtccctatcgttgacacaccaaactaccgcacagaagttccagggcngactcaccataaccgcgacaaataacgaacacagtaatctgagctgaacagcctgtcatctagaggacacgggcttctacttctgtgcgaggagtaattactataacactagcttccttttacaccttcccttgtaccttctcggggtccagtcggaacccggtcc

SEQ ID NO: 342306 - DNA, 564 bp, Homo sapiens
  misc_feature: GZ8MTXP02IVLAX.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaagtccttgagtggatgggaaggatcgtccctatcgttgacacaccaaactaccgacacagaacgttccagggcagactcaccataaccgcgaacaaataacgaacacagtaatctgagctagaacagacctgtacatctagaggacacgggtcttacgtacttctgtgcgtaggagtaattactaataactactagtaccttacctttacctacccttcccttcgtaccttcgtcggggtaccacgtccggaaccccggttccc

SEQ ID NO: 342307 - DNA, 543 bp, Homo sapiens
  misc_feature: GZ8MTXP02JPJUF.17.34.D01.1.454.CMB.2.raw
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactaccgcacagaacgttccagggcngactcaccataaccgcggaacaaattaaacgaacaacagttaanctgagctagaacagcctgtacatctgaggacacgggcttcgtacttctgtgcgagagtaatactataacactcgtcttcctttacgcccttcctgtacttcgtcgggccacgtacggaacccgtccg

SEQ ID NO: 342308 - DNA, 562 bp, Homo sapiens
  misc_feature: GZ8MTXP02F9SQZ.17.34.D01.1.454.CMB.2.raw
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtgacaggaacccttggtcttcggcgagtgggcttttcaccgctttatcgttacctatgtcagcattcgcacttctgatacctcagcatgcctcacagcacaccttcacagcttacagaaaccgctacccctacccaacaacgcataacgcgtacgctgccgcacgcttcggtgccagttcggtttacgccccgtttcactccttcccgctactctcgactagtacc

SEQ ID NO: 342309 - DNA, 590 bp, Homo sapiens
  misc_feature: GZ8MTXP02I0LXB.17.34.D01.1.454.CMB.2.raw
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgttcccatcgactacgccttcggcctcgccttagggtcactcaccctgccccgattaacgttggacaggaacccttggtcttccggcgagcggggctttcgacccgtacgttacgtcgttaccttagtgtcagcattcgcacttctgatacctcagcatcncncacacncacacctcacacgactacacgacgacctaccctacccaaccaaccgacaactacgacgtcgcgtcgccgacgacgtcgtcgtcgtcgtacgttacggttaccgtcccgtccttcctaacgtcctcccgtcctactctacgtacgtacg

SEQ ID NO: 342310 - DNA, 548 bp, Homo sapiens
  misc_feature: GZ8MTXP02HL8MN.17.34.D01.1.454.CMB.2.raw
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaagatcgtccctatcgttgacacaccaaactaccgcacagaagttccagggcngactcaccataaccgcggaacaaataacgaacacagttaanctagagctagaacagcctgtacatctgagacacgggcttcgtacttctgtgcgaggagtaattactataacactgcttaccttttacaccttcccttgtaccttcgtcggggtacctacgtcggtaaccccggtccg

SEQ ID NO: 342311 - DNA, 558 bp, Homo sapiens
  misc_feature: GZ8MTXP02HRH96.17.34.D01.1.454.CMB.2.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaaggatcgtccctatcgttgacacaccaaactaccgcacagaagttcagggcagactcaccataaccgcgacaaataacgaacacagtaanctganctagaacagacctgtcatctagtagggacacggggcttcgtacttcgtgtgcgtagggtagtaaattactattaaacacgtagtcctttaccttttactacccttccttcgtacttcgtcgggcctacgtcggtaaccccgtccg

SEQ ID NO: 342312 - DNA, 529 bp, Homo sapiens
  misc_feature: GZ8MTXP02F9UGC.17.34.D01.1.454.CMB.2.raw
  modified_base (263)..(263): a, c, t, g, unknown or other
  misc_feature (263)..(263): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctccatctcctgcaagtctagtcagagcctctgcatagtggtagaaggaaagaccttnttatattggtcctgcagagccaggccagtctccacacctctgactttacgacgtttcccaaccgcttcgctggactgccagatagtcagtgcagcggtcagggacagtatttacactagaaaatcgaggccgggtaggaggcgtaggaggtacgttagggtaatttaagttactagtatagagaaggtatagagtcttcctccgtacgttcggaccgaaacggaccgaaggtaacggaaactacgaaacgacgtagtcggactacg

SEQ ID NO: 342313 - DNA, 562 bp, Homo sapiens
  misc_feature: GZ8MTXP02I8A6X.17.34.D01.1.454.CMB.2.raw
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (371)..(372): a, c, t, g, unknown or other
  misc_feature (371)..(372): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (385)..(387): a, c, t, g, unknown or other
  misc_feature (385)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(396): a, c, t, g, unknown or other
  misc_feature (395)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttcgcagtaacaccaagtacaggaatattaacctgttcccatcgactacgccttcggcctcgcctaggggtcactcacctgccccgattacgtgacagacctgctcggnagcggcttgccntanctactanncancatcncnctnnncncncncnncncncacacacacacctacacacgactacacgacacctacccctaacccaaccaaccgaacaacgaacgacgtacgcgtcgaccgacgacgtacgtcgtcgtacgtacgttacgttaccgtacccgttacctactccgtccgtacctactctacgtacgtacgtcg

SEQ ID NO: 342314 - DNA, 576 bp, Homo sapiens
  misc_feature: GZ8MTXP02JKDLK.17.34.D01.1.454.CMB.2.raw
  modified_base (520)..(520): a, c, t, g, unknown or other
  misc_feature (520)..(520): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggacccttggcttccggcgagcgggcttttcaccgtctttatcgttaccttatgtcagcattcgctacttctgactacctcagcatgccctcacagcacaccttcacacgcttacacgaaccgcctaccccctaacccaacaacgcaataacgcgtacgctcgccgcagtcttcggngccagttcggtttacgccccgtcttcaacttccttcccgctactctacgacttacg

SEQ ID NO: 342315 - DNA, 540 bp, Homo sapiens
  misc_feature: GZ8MTXP02G4IJ8.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaagaccttcttatattggttcctgcagaggccaggccagtctccacacctcctgatttacgaacgtttccaaccgtcttcgctggactgccagatagttcaggtgcgagcgggtcgagggacgagtagtttacactagaaatacgagccgggtaggaggcgtaggaggtacggttaggtaagtttagttactagtatgtagaaggtatagacgtcgttcctccgtacgtcggtaccgaacggacgaaggtaaggaacgtacgaacgaaaaacgtgtacggcgtacg

SEQ ID NO: 342316 - DNA, 540 bp, Homo sapiens
  misc_feature: GZ8MTXP02HK4E8.17.34.D01.1.454.CMB.2.raw
tcagcgtagactagcacgaccggtgctcgatttagatcgtctgtgttgggtttgggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatatttggttcctgcagaggccaggccagtctccacacctcctgatttacgaacgtttccaaccgcttcgctggactgccagatagttcagtgcagcgggtcagggacagattttacactagaaaatcagccgggtggacggcgtaggagggacggtttagggaaattttattaagttgtaatgactaaaggtataggagtcctttccgtaccgacgttcggaccgaaacggggaccaaagggtggaactacgaaaacgaacgtgtacggtctcg

SEQ ID NO: 342317 - DNA, 560 bp, Homo sapiens
  misc_feature: GZ8MTXP02FOMO4.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctccatctcctgcaagtctagtcagagcctcctgcatagtggtgaaggaaagaccttcttatattggttcctgcagaggccaggccagtcctccacaccctcctgtatttacgaacgtttcccaaccgcttcgctggactgccagatagttcagtgcagcggtcgaggacagtatttacactagaaaatcgaggccgggtaggacggcgtaggagggtacgttagggtaaatttagttacgttagtagttgacgtaaaggtataagacgtcgttccctacccggtacggttccggaccgaaacggggaccgaaacgggtaaggaaacgtacgaaaacgaacgtagtacggactcg

SEQ ID NO: 342318 - DNA, 549 bp, Homo sapiens
  misc_feature: GZ8MTXP02IDEKF.17.34.D01.1.454.CMB.2.raw
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttctggaggcaccttcagcgactatagttcaattgggtgcgacggcctctggacaaggccttgagtggatgggaagatcgtccctatcgttgacacacaactacgcanagaagtcaggcngactcaccataaccgcgaacaaataacgaaacacagtaatctagagctagaaacagcctagtacatctagaggacacgggcttctacttctgtgacgagagtaattacgtataacactgtaccttaccttttacacccttcccttaacgtacttcgtcggggacctacgtccggaaaccccggtccg

SEQ ID NO: 342319 - DNA, 564 bp, Homo sapiens
  misc_feature: GZ8MTXP02JD8LW.17.34.D01.1.454.CMB.2.raw
  modified_base (448)..(448): a, c, t, g, unknown or other
  misc_feature (448)..(448): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaaggaaagaccttcttatatttggttcctgcagaggccaggccagtcctccacaccctctgatttacgacgtttccaacgtctcgctggactgccagtatacgtcagtggcagcgggtcagggacagtatttacactagaaaatcgaggcgggtaggaggcgtaggaggtacggttggtaaatttagttatagttanacgtagaaaggtataagacggtccttaccgtccggtacggtttaccgggaccgaaaacggggtacccgaaagggttcggaaactaacgaaaaccggaacgtggtacggaccgtacg

SEQ ID NO: 342320 - DNA, 544 bp, Homo sapiens
  misc_feature: GZ8MTXP02F0NFS.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaaggatcgtccctatcgttgacacaccaaactaccgcacagaacgttccagggcagactcaccataaccgcgaacaaataacgaacacaagtaatctagagctagaacagcctgtacatctgacgacgacgggcttctacttctgtgcgagagtaatactatacactcgcttcctttacacccttccttgtacttcgtcgggacctacgtaccggacccgtaccg

SEQ ID NO: 342321 - DNA, 402 bp, Homo sapiens
  misc_feature: GZ8MTXP02JYQER.17.34.D01.1.454.CMB.2.raw
  modified_base (373)..(373): a, c, t, g, unknown or other
  misc_feature (373)..(373): n is a, c, g, or t
  modified_base (379)..(402): a, c, t, g, unknown or other
  misc_feature (379)..(402): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtccccccttgcagtaacaccaagtacaggaatattaacctgttcccatcgactacgcctttcggcctcgccttaggggtcactcaccctgccccgattaacgtggacaggaacctggtctcggcgagcggctgcagtcnactagnnnnnnnnnnnnnnnnnnnnnnnn

SEQ ID NO: 342322 - DNA, 553 bp, Homo sapiens
  misc_feature: GZ8MTXP02HRR1G.17.34.D01.1.454.CMB.2.raw
  modified_base (385)..(385): a, c, t, g, unknown or other
  misc_feature (385)..(385): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgccttaggggtcactcaccctgccccgattaacgttggacaggaacccttggtctccggcagcgggcttttcacccgtctttancgttacctatgtcagcattcgcacttctgactacctccagcatgcctcacagcacaccttcacagcttacagaacgctccctaccaacacgcanagctcgctgccgnagctcggtgctatcggttacgccccgtttcacttccttcccgcctactctcgacttagtcc

SEQ ID NO: 342323 - DNA, 537 bp, Homo sapiens
  misc_feature: GZ8MTXP02JDGAQ.17.34.D01.1.454.CMB.2.raw
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaaggatcggtccctatcgttgacacacaaactaccgcacagaagttccagggcagactcaccataaccgcgaacaaataacgaacacagttaanactaganctagaacagacctgtcatctgagacacgggacttctacttctgtgcgagagtaatactataaacactgcttcctttacaccttccttcgacttcgtcgggtccacgtacgaacccgtcc

SEQ ID NO: 342324 - DNA, 556 bp, Homo sapiens
  misc_feature: GZ8MTXP02HBWFK.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtagaaaggaaagtaccttcttatatttggttcctgcagaggccaggccagtcctccacacctctgatttacgacgtttccaaccgtcttcgctgactgccagatagttcagtgcagcggtcgaggacagtatttacactagaaaatcgaggccgggtaggacggcgtggaggtacggttaggtaatttagttacgtagtatgacgtaaggtatagtacgtcgttacccgtccggtaccggttcggaccgtaacgggaaccgaagggtaacggaacgtacgaaaacgtacgtacggtacggtacgtacg

SEQ ID NO: 342325 - DNA, 612 bp, Homo sapiens
  misc_feature: GZ8MTXP02HUTJS.17.34.D01.1.454.CMB.2.raw
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcactcaccctgccccgattaacgttggacaggaacccttggtcttccggcgagcggggctttcgacccgtcgttactcgttaccttatgtcagtcattcgcacttctgactaccctcagcatcnctcacacncacacctacacacgactacacgaccgacctacccctaacccaaccaaccgaccaacaacgacgtcgcgtcgccgcgacgtccgttcggtcgtacgtacgttacggtttaccgttacccgtttacctacttccgttcccgtacctactacctacgtacgttacgtacg

SEQ ID NO: 342326 - DNA, 546 bp, Homo sapiens
  misc_feature: GZ8MTXP02HJW80.17.34.D01.1.454.CMB.2.raw
  modified_base (417)..(417): a, c, t, g, unknown or other
  misc_feature (417)..(417): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctcgtggacaaggccttgagtggatgggaagatcgtccctatcgttgacacaccaaactaccgcacagaagttccagggcagactcaccataaccgcgaacaaataacgaacacagtaatctaganctagaacagcctgtcatctgagacacgggcttcgtacttctgtgcgagagtaattactaataacactgtacttaccttttacacccttccttgtacttcgtcgggacctacgtacggtaaccccgtccg

SEQ ID NO: 342327 - DNA, 610 bp, Homo sapiens
  misc_feature: GZ8MTXP02IM5PP.17.34.D01.1.454.CMB.2.raw
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggngcgacggctctggacagctgagtggatggagatcgtccctatcgttgacacaaccaaactaccncacagaagttcagggcagactacaccataaccgacgaaacaaataaacgaacaacaagttaatactaggacgactagaaacaacgcctagtacaattccgtagaaggacaacggggtctttaccgtacttacgtggttgacggaaggtaagtaaactttaactaaacttaaacgtacttacgttcctttacccttttaactacccctttaccttaacgtactttaccgtcggggacctacggtaccggtaacccccggttacccg

SEQ ID NO: 342328 - DNA, 578 bp, Homo sapiens
  misc_feature: GZ8MTXP02HSNRS.17.34.D01.1.454.CMB.2.raw
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgcctagggtcgactcaccctgccccgattaacgttggacaggaacccttggtcttccggcgagtcggggcttttcgacccgtcgttatccgttaccttatcgtcagcattcgcacttctgatacctccagcatgcctcacagcacncttcactagcttacanaacgctcccctacccaanaaccgcataaagcgtcgctgcccgnacgtctcggncgtagttcggttaccgtcccgtttcacttccgtccccgactactctacgtacgttacgtccg

SEQ ID NO: 342329 - DNA, 642 bp, Homo sapiens
  misc_feature: GZ8MTXP02FUQQL.17.34.D01.1.454.CMB.2.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacggcctcgtggacaaggccttgagtggatgggaagntcgtccctatcgttgacacaccaactaccgcacagaacgttccagggcagacctacaaccactaaccgacgaaactaaaacttaaacgaaacaacaagttaaatacgtaggacgactagaacacgacctgtacatcgtaggacggacgaaccggggtcttaccgtactttcgtggtcgacggaaggtagttaaacttaactaactaaacctacgttacgttacctttaccctttttaccctacccctttaccccgttaacgttacctttccggttaccggggtcctaacggtacccggtaacccccggtttaccccg

SEQ ID NO: 342330 - DNA, 588 bp, Homo sapiens
  misc_feature: GZ8MTXP02H65TC.17.34.D01.1.454.CMB.2.raw
  modified_base (376)..(376): a, c, t, g, unknown or other
  misc_feature (376)..(376): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (507)..(507): a, c, t, g, unknown or other
  misc_feature (507)..(507): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggccaacatagccttctccgtcccccttgcagtaacaccaagtacaggaatattaacctgtttcccatcgactacgcctttcggcctcgccttagggcactcaccctgccccattaacgtgacaggacccttggcttcggcgagcgggtctttcgacccgtnttactcgttacttagtcgtcacgctattcgctacttctgtactacctcagcatcgcctcacacncacncctacacgacgtctacacgacctcctaccccaccaacaacacaacacgcgtcgctcgccgacncgtcgttacgtcgtacgtacgttacggttaccgtacccgttacctacttccgttcccgtacctactactcgtactacgtcg

SEQ ID NO: 342331 - DNA, 562 bp, Homo sapiens
  misc_feature: GZ8MTXP02JSFXA.17.34.D01.1.454.CMB.2.raw
  modified_base (411)..(411): a, c, t, g, unknown or other
  misc_feature (411)..(411): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagacgcctcctgcatagtggtagaaggaagaccttcttatatttggtcctgcagaggccaggccagtctccacacctctgtactttacgaacgtttccaaccgtcttcgctggactcgccagatagttcagtggcaggcggtagagggacagtatttacactagaaaatcgagtcgggtagngcgtagaggtacgttagggtaatttaagtacttgtacgtgtacgtaaaggtataagtacgttaccttcccgtacggtacggttccggaccgaaacggggtacgtaaacgggtaacgaaacgtaccgaaaacgtacgtcggtacggctaccg

SEQ ID NO: 342332 - DNA, 540 bp, Homo sapiens
  misc_feature: GZ8MTXP02F3M4M.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtagaaaggaaagtaccttcttatattggttcctgcagaggccaggccagtcctccacacctcctgtattacgaacgtttccaaccgtcttcgctggactgccagatagttcagtgcagcggtcgagggacagtatttacactagaaatcgaggccgggtggaggcgtaggaggtacgttaggtaatttagttatgtagtgacgtaagtatagtacgtccttccgtccgtacggttcggaccgaacgggaccgaaggtaacggaaactacgaaacgaacgtggtacggctacg

SEQ ID NO: 342333 - DNA, 566 bp, Homo sapiens
  misc_feature: GZ8MTXP02FSFZY.17.34.D01.1.454.CMB.2.raw
  modified_base (383)..(383): a, c, t, g, unknown or other
  misc_feature (383)..(383): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (514)..(514): a, c, t, g, unknown or other
  misc_feature (514)..(514): n is a, c, g, or t
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgccttcggcctcgccttaggggtcactcaccctgccccgattaacgttggacaggaacccttggtcttccggcgagcgggcttttcgacccgntttatcgttaccttatgtcagcattcgcacttctgactacctcagcatgcctnacngcacaccttcacaggcttacagaaccgctaccccctaccaacaacgcactaagcgtcgctcgccgcagtctcggngcattcggtttacnccccgtttnactccttcccgctactccgtacactactc

SEQ ID NO: 342334 - DNA, 565 bp, Homo sapiens
  misc_feature: GZ8MTXP02ICU0Z.17.34.D01.1.454.CMB.2.raw
  modified_base (417)..(417): a, c, t, g, unknown or other
  misc_feature (417)..(417): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggagatcgtccctatcgtgacacaccaactccgcacagaagttccagggcagactcaaccactaacccgcggaacaaaataacgaacacagtaatctgganctagaacagacctgtacatctaggaggacgacgggtcttccgtacttactgtgcgaggtagtaattactataacacttcgtaccttaccttttacctaccttacccttgtaccttacgtcggggtcctacgtcggaaccccggttccc

SEQ ID NO: 342335 - DNA, 569 bp, Homo sapiens
  misc_feature: GZ8MTXP02HS7EZ.17.34.D01.1.454.CMB.2.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
  modified_base (539)..(539): a, c, t, g, unknown or other
  misc_feature (539)..(539): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgcctttcggcctcgccttaggggtcgactcaccctgccccgattaacgtggacaggaacccttggtcttccggcgagcgggcttttcgaccgtctttatcgttacctatgtcagcattcgcacttcngactcctcagcatgccctnacagcacaccttcacaggcttacagaaccnctacccctacaacaacgcataacgctcgctgccgcacggcttcgggtcactacgttcggtttacgcccccgtttnacctccttcccgcactcgtcacttacgtcc

SEQ ID NO: 342336 - DNA, 570 bp, Homo sapiens
  misc_feature: GZ8MTXP02GOO26.17.34.D01.1.454.CMB.2.raw
  modified_base (323)..(323): a, c, t, g, unknown or other
  misc_feature (323)..(323): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctcgtggacaaggccttgagtggatgggaaggntcgtccctatcgttgacacaccaaactacccgcacagaacgttccaggcagactcaccataccgngaacaaataacgaacacattaanctaganctagaacagctgtacatctgagacacgggtcttctacttctgtgtacgaggtattaacgttactaataactactcgtacctttacccttttaccaccctttcccttaagtaccttcgtacggggcctacggttaccggtaaccccgttacccg

SEQ ID NO: 342337 - DNA, 550 bp, Homo sapiens
  misc_feature: GZ8MTXP02HE3BA.17.34.D01.1.454.CMB.2.raw
  modified_base (409)..(409): a, c, t, g, unknown or other
  misc_feature (409)..(409): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacggcctctggacaaggccttgagtggatgggaagatcgtccctatcgttgacacaccaaactaccgcacagaacgttccaggcagactcaccataaccgcgaacaaataacgaacacagtaanctagagctagaacagcctagtacatctagagacacgggcttacgtacttctgtcgcgagagtaattactataacactgtacttccttttacacccttaccttcgtacttcgtcgggtaccacgtccggtaaccccgtcccg

SEQ ID NO: 342338 - DNA, 571 bp, Homo sapiens
  misc_feature: GZ8MTXP02GYOLY.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctctgcatagtggtagaaaggaagaccttctatattggttcctgcaggaggccaggccagtcctccacacctcctgactttacgaacgtttccaacgtctcgctggactgccagatagttcagtcggacagcggtacgagggacagtatttacactagaaaactcgaggccgggtaggaggtctagggaggtacggttagggtaaattttaagttagtaggttatagtacgtaaaggtataaggtacgtccgttaccgtccggtaacggttacggaccgtaaaacggggaccgtaaaggtaaggaactaacgaaaaccgaagtggtacggcgtaccg

SEQ ID NO: 342339 - DNA, 540 bp, Homo sapiens
  misc_feature: GZ8MTXP02JXY6M.17.34.D01.1.454.CMB.2.raw
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacggcctcgtggacaaggccttgagtggatgggaagatcgtccctatcgtgacacacaaactacgcacagaacgtccagggcngactcacataccgcgacaaataacgaacacagtaanctaganctagaacagcctgacatctagagacacgggtctcgtacttctgtcgacgagtagtaattacgtataacactacgtcttacctttacacccttcctgtaccttcgtcgggtaccacgttcggaacccgtccg

SEQ ID NO: 342340 - DNA, 547 bp, Homo sapiens
  misc_feature: GZ8MTXP02JUTUP.17.34.D01.1.454.CMB.2.raw
  modified_base (321)..(321): a, c, t, g, unknown or other
  misc_feature (321)..(321): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggccttgagtggatgggaagntcgtccctatcgttgacacaccaaactaccgcacagaagttccagggcagactcaccataaccgcgacaaataacgaacacagtaatctagagctagaacagcctgtacatctgagacacgggcttctacttctgtgcgaggagtaattactaataacactgtacttccttttactacccttcccttgtactttcgtcggggtcctacgtacggaccccgttaccg

SEQ ID NO: 342341 - DNA, 600 bp, Homo sapiens
  misc_feature: GZ8MTXP02G81MC.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcggacgggcctctggacaaggccttgagtggatgggaaggatcgtccctatcgttgacacaccaaactaccgcacagaagttccagggcagactcaccataaccgcgaacaaattaaacgaacaacagtaatactaggagactgaaacagacctgtacatacctagaaggacgacggggtcttaccgttacttcgtacgtgacggaggtagttaaagttaactataaactacgttacgtaccttaccttttaccacccttacccgttaacgttacctttacgtcggggtacctacgtaccggaaaccccggttcccg

SEQ ID NO: 342342 - DNA, 530 bp, Homo sapiens
  misc_feature: GZ8MTXP02GJPHE.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggagatcgtccctatcgttgacacaccaaactaccgcacagaagttccaggcagactcaccataaccgcgaacaaataacgaacacataatctgagctagaacagcctgtacatctgagacacgggctctactctgtgcgagagtatactatacactgctcctttacaccttcccttcgtacttcgtcgggacctacgtacggaaccccgtccg

SEQ ID NO: 342343 - DNA, 631 bp, Homo sapiens
  misc_feature: GZ8MTXP02I81RP.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgccgtgggtcctcggtgagggtctcctgcaaggcttcgtggaggcaccttcagcgactatagttcaagttgggtgcgacggcctcgtggacaaggtccttgagtggagtgggaagatcgtccctatcgtagacacaccaactccgcacagacgttcagggcagacctcaaccacgtaaccgacgaaactaaaacgttaaacgaaacaactaagttaactacgtaggacactagaaactacgacctgtacatcgtaggacgacgacgggtacttaccgtacgttcgtggtacggcgtaaggtaagttaacttaactaactaactacgttacttaccttttaccttttaaccctccctttacccgttaacgttccgtttaccggtacgggtaccctacggtaccccggtaacccggttcccg

SEQ ID NO: 342344 - DNA, 568 bp, Homo sapiens
  misc_feature: GZ8MTXP02HJJB4.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagcccggcctccatctcctgcaagtctagtcagacgccctcctgcataggtgggtagaaaggaaagtaccttcttattatttggttcctgcaggcggccaggccagtcctccacacctcctgtactttacgaaccgtttcccaaccgtcttacgctggactgccagataggttcaggtggcgagcgggtcagggacagtatttacactagaaaatcgaggccggggtaggaggcgtaggtagggtacggttaggtaatttagttatagtagtgacgtaaggtatagtacgtcttccgtccgtacggttcggaccgtaacgggaccgtaaggtaacgaactacgaaaacgtaacgtcggtacggtctacg

SEQ ID NO: 342345 - DNA, 540 bp, Homo sapiens
  misc_feature: GZ8MTXP02FPO38.17.34.D01.1.454.CMB.2.raw
  modified_base (323)..(323): a, c, t, g, unknown or other
  misc_feature (323)..(323): n is a, c, g, or t
  modified_base (413)..(413): a, c, t, g, unknown or other
  misc_feature (413)..(413): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggntcgtccctatcgttgacacaccaaactaccgcacagaagttccagggcagactcaccataaccgcgaacaaataaacgaacacagttaanactgagctagaacagcctgtcatctgagacgacgggcttctacttctgtgcgagagtaattactataacactgtcttccttttacaccttcccttgtacttcgtcgggccacgtcggaacccggtcc

SEQ ID NO: 342346 - DNA, 586 bp, Homo sapiens
  misc_feature: GZ8MTXP02JIM8D.17.34.D01.1.454.CMB.2.raw
  modified_base (572)..(572): a, c, t, g, unknown or other
  misc_feature (572)..(572): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgttcccatcgactacgccttcggcctcgccttaggggtcactcaccctgccccgattaacgtggacaggaacccttggtcttccggcgagcgggtctttcgacccgtcgttactcgttaccttatgtcagcattcgctacttctgactacctcagcatcgcctcacagcacaccttcactagcttacacgaccgctccccctaaccaacaaccgcaacgtaacgccgtcgctcgcccgctgtcttcggtgaccgagttcggtttaccgccccgtctttccaacttcccttcccgcctntactcgtacttacg

SEQ ID NO: 342347 - DNA, 568 bp, Homo sapiens
  misc_feature: GZ8MTXP02IONRU.17.34.D01.1.454.CMB.2.raw
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaattgggtgcgacgggcctctggacaaggccttgagtggatgggaagatcgtccctatcgttgacacaccaaactccgcaanagaagttccaagggcaggactcacccataacccgcgaacaaaataacgaaacacaagtaatactaganctagaacagcctagtcatctagagacacgggcttctacttctgtgacgaggtataagttactataacactacgtactttaccttttacctaccttcccttaagtacttcgtcggggtacctacgtacggtaacccccggttccg

SEQ ID NO: 342348 - DNA, 550 bp, Homo sapiens
  misc_feature: GZ8MTXP02IQPWF.17.34.D01.1.454.CMB.2.raw
  modified_base (362)..(362): a, c, t, g, unknown or other
  misc_feature (362)..(362): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgagacgcctgggtcctcggtgagggtctcctgcaaggcttctggaggcaccttcagcgactatagtttcaattgggtgcgacggcctctggacaggccttgagtggatggagatcgtccctatcgttgacacaccaactccgcacagaagtccaggcngacctcaccataacccgacggaactaaataaacgaacaacagtaatctagagctagaacagcctgtcatctagagacgacgggcttctacttctgtgcgaggagtaattactataacacttgtaccttccttttaccacccttaccttcgtacttcgtacgggtacctacgtaccggtaacccgtccg

SEQ ID NO: 342349 - DNA, 612 bp, Homo sapiens
  misc_feature: GZ8MTXP02JBD55.17.34.D01.1.454.CMB.2.raw
  modified_base (378)..(378): a, c, t, g, unknown or other
  misc_feature (378)..(378): n is a, c, g, or t
  modified_base (571)..(571): a, c, t, g, unknown or other
  misc_feature (571)..(571): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgttcccatcgactacgccttcggcctcgccttagggcactcaccctgccccgattacgtggacaggaacccttggtcttccggcgagccgggtcttttcacccgtntttactcgttaccttatgtcagctattcgctacttctgactaccctcaagcatcgccctcaacagccaacacccttcacaggccttaacagaaccgcctaccccctaacccaaacaaccgaccaagtaacgcgttaccgcgtcgcccgacacgtcttccggtgacctagttcgggtttacgacccccgttttnaccttcccgtaccccgactactcgtacgtacctacgtaccg

SEQ ID NO: 342350 - DNA, 685 bp, Homo sapiens
  misc_feature: GZ8MTXP02I4KNZ.17.34.D01.1.454.CMB.2.raw
  modified_base (287)..(287): a, c, t, g, unknown or other
  misc_feature (287)..(287): n is a, c, g, or t
  modified_base (329)..(329): a, c, t, g, unknown or other
  misc_feature (329)..(329): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctccgtgcaaggtcttcgtggaggctaccttcagcgactatagtttcaattgggngcggacggcctcgtggacaaggccttgagtggagtgggaagntcgtccctagtcgttgacaccgaaccaaactccgacactagaagttcaggcagactcaaccactaaccgacgaaactaaaacttaaaccgaaactaacctaagttaaagtaccgtaaggacgtaccgtaagaaacacggtacctaggtacaagtccgtaggacggacgtacgggtaccttaccgttacgttcgtggtacggtacggtaagggtaacttaaaacgttaactaacgtaaacttaaccggttacgttccctttacctttttaaccctacccctttacccgttaaccgttaccgtttccggtaccggggtaccctaacggtttacccgggtaaacccccgggtttccccg

SEQ ID NO: 342351 - DNA, 608 bp, Homo sapiens
  misc_feature: GZ8MTXP02IFZIZ.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctcgtggacaaggccttgagtggatgggagatcgtccctatcgttgacacaccaaactaccgacacagaacgttcagggcagacctacaacccactaaccgacggaaacaaaattaaacgaaacactaagtaatcgtagagctagaacagcctgtcatctgaaggacacgggtcttctacttcgtgtgcgtaggagttaaataactataaacacttacgtacctttacccttttaaccttacccttaccctttaacggtacccttttacgtaccgggggtacctaaccggtttccggtaaacccccgggttccccg

SEQ ID NO: 342352 - DNA, 536 bp, Homo sapiens
  misc_feature: GZ8MTXP02IASBE.17.34.D01.1.454.CMB.2.raw
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctgggaggcaccttcagcgactatagttcaattgggtgcgacgggcctcgtggacaggccttgagtggatgggagatcgtcctatcgtgacacacaactccgcacagagttcaggcagactcaccataaccgcgaacaaatacgaacacagtaanctaganctagaaacngcctgacatctaggagacacgggtcttcgtacttctgtgcgagtagtaattacatacactcgtacttacctttacacccttcctaacgtactcgtcgggacctacgtaccggtacccgtcc

SEQ ID NO: 342353 - DNA, 590 bp, Homo sapiens
  misc_feature: GZ8MTXP02HAGPQ.17.34.D01.1.454.CMB.2.raw
  modified_base (429)..(429): a, c, t, g, unknown or other
  misc_feature (429)..(429): n is a, c, g, or t
  modified_base (487)..(487): a, c, t, g, unknown or other
  misc_feature (487)..(487): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctggaggtgaagacgcctgggtcctcggtgagggtctcctgcaaggcttcgtggaggcaccttcagcgactatagttcaagttgggtgcgacggcctcgtggacaaggccttgagtggatgggaagatcgccctatcgttgacacaccaaactacccgctaaccagaacgttccgaagggcagactcaaccataacccggacgaaacaaacttaaacgaacaactaagtaancgtgacgctagaacagcctgtacatacaggaacgacgtaccgggtcttacgtacttcngtcgacgtaggtataacttacgtaactaactacttagtccttaccttttaccacccttcctaacgtacttcgtcgggtacctacggtacccggaacccgtccg

SEQ ID NO: 342354 - DNA, 602 bp, Homo sapiens
  misc_feature: GZ8MTXP02GVSZA.17.34.D01.1.454.CMB.2.raw
  modified_base (325)..(325): a, c, t, g, unknown or other
  misc_feature (325)..(325): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttcgtggaggcaccttcagcgactatagtttcaagttgggtgcggacgggcctcgtggacaaggccttgagtggatgggaagntcgtccctatcgtgacacaccaaactaccgcacagaacgtccagggcagactcaccataaccgacgaacaaataaacgaacaacaagtaatacgtgagactagaacagcctacgtacactcgtaggagtaccgacgggtcttacctacttcgtgtcgacggaggtaagttaacgttaactaagtaacacgttacgtactttaccctttttaccgtcccttcccgttcgtaccgtttacgtcggggtaccctacgttaccgggtaacccccgttcccg

SEQ ID NO: 342355 - DNA, 595 bp, Homo sapiens
  misc_feature: GZ8MTXP02HCU32.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggcttcgtggaggcaccttcagcgactatagttcaattgggtgcggacggcctcgtggacaaggccttgagtggagtgggagatcgtccctatcgtgacacaaccaaactaccgcacagaacgttccgaggcagacctcaaccataacccgacggaacaaactaaacgaacaacagtaatcagagacagaacagcctagtacatacgtgagacacgggtcttctacttctgtcgacgagtaagtaacgttactaactaactactcgttacctttaccctttttaccacccctttaccgttaacgtaccgtttaccggtcgggtacccgtacgtaccggtaacccccggttcccg

SEQ ID NO: 342356 - DNA, 532 bp, Homo sapiens
  misc_feature: GZ8MTXP02IBZP7.17.34.D01.1.454.CMB.2.raw
  modified_base (368)..(368): a, c, t, g, unknown or other
  misc_feature (368)..(368): n is a, c, g, or t
  modified_base (492)..(492): a, c, t, g, unknown or other
  misc_feature (492)..(492): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctcgtggacaaggccttgagtggatgggagatcgtccctatcgttgacacaccaaactccgcacagaagttccaggcngactcaccataccgcggacaaataacgaacacagtaatctagagctagaacagcctgtcatctgacggacacgggcttctactctgtgacgagagtaattactatacactgtacttcctttacnccttcctgtacttacgtcgggcctacgtcgtacccggtcc

SEQ ID NO: 342357 - DNA, 674 bp, Homo sapiens
  misc_feature: GZ8MTXP02JVAJQ.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttctggaggcaccttcagcgactatagtttcaattgggtgcgacgggcctcgtggacaaggccttgagtggatgggaaggatcggtccctagtcgttgacacaccaaactaccgcacgagaacgttccgagggcagacctacaaccagtaaccgcggaaacaaaagttaaaccgaaacaacctaagttaaatcgtaggagacctagaaacgacgacctagtactagtccgtggaacggacgtacggggtcctttacgttaaccgtttcgtcggttggaccggtaagggtaaacgttaaactttaacgtaaacttaaacgtaccgtacgttaccttttacccgttttaccctaaccccgttttacccgttaacgtaacccgttttaccggtcgggggtaccctaccggttaccgggtaaacccccggttcccg

SEQ ID NO: 342358 - DNA, 613 bp, Homo sapiens
  misc_feature: GZ8MTXP02GO2Q8.17.34.D01.1.454.CMB.2.raw
  modified_base (389)..(389): a, c, t, g, unknown or other
  misc_feature (389)..(389): n is a, c, g, or t
  modified_base (583)..(583): a, c, t, g, unknown or other
  misc_feature (583)..(583): n is a, c, g, or t
  modified_base (594)..(594): a, c, t, g, unknown or other
  misc_feature (594)..(594): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttcctccgtccccccttgcagtaacaccaagtacagaatattaacctgttcccatcgactacgccttcggcctcgccgttaggggtcactccaccctgccccgtattaacgtggacacggaacccttggtcttccggcgaggcgggtcttttccgacccgtntttatcgttactatgtcagctattcgctacttctgactccctcagcatcgcctcacagcccactacccttcaccgaggtaccttaacagaccgcctccccttaccccaaccaaaccaccgacaacgtaacgcgtacgcgtccgccgacgtcgtccgttcggcgtactacgtttccggttacccgttcccttacncttcccgtccnctactcgtacgtacttacg

SEQ ID NO: 342359 - DNA, 653 bp, Homo sapiens
  misc_feature: GZ8MTXP02I0Z5R.17.34.D01.1.454.CMB.2.raw
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagcgtagactagcacgaccggtgctcgatttagatcgtctgtgttgggtttggggatcacaaaacaaccagattcctcctctaaagaagcccctgggagcacagttcatcaccatggactggacctggaggttcctctttgtggtggcagcagctacaggtgtccagtcccaggtccagttggtgcaatctggggctgaggtgaagacgcctgggtcctcggtgagggtctcctgcaggcttctggaggcaccttcagcgactatagtttcaagttgggtncgacgggcctcgtggacaaggccttgngtggatgggaagntcgtccctatcgttgacacaccaaactcgccacagaacgttccaggccagctcaccagtaacccgcgaaacaaattaaccgaaacaactaagttaactacgtaggagacgtacgaaacacgtaccctagtacctaagtccgtaggaacggtaccgaccggggtcctttaccgttacctttccgtagtcggtacggtaggtaagttaaacttaacttaactaaactacttacgtacctttacctttttaccgtacccctttcccgtttacgtaaccgtttaccgtacggggtaccctacgtacccggtaacccccggttccgttaaccccg

SEQ ID NO: 342360 - DNA, 590 bp, Homo sapiens
  misc_feature: GZ8MTXP02F8TXR.17.34.D01.1.454.CMB.2.raw
  modified_base (437)..(437): a, c, t, g, unknown or other
  misc_feature (437)..(437): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcagtaacaccaagtacagaatataacctgttcccatcgactacgcctttcggcctcgccttaggggtcactcaccctgccccgattaacgtggacaggaacccttggtcttccggcgagcgggcttttcgaccgtgtttactcgttaccttatgtcagcattcgcacttctgactacctccagcatgcctcacancacaccttacacacgcttacacgaacacctacccacccaaccaacacacaacgacgcgccgcgccgcacgtcgttcggtcgtcgtacgttacggttaccgttcccgttcctaccgttccgttcccgtacctactacgtacgtacgtacgtacg

SEQ ID NO: 342361 - DNA, 574 bp, Homo sapiens
  misc_feature: GZ8MTXP02JW1U6.17.34.D01.1.454.CMB.2.raw
  modified_base (381)..(381): a, c, t, g, unknown or other
  misc_feature (381)..(381): n is a, c, g, or t
  modified_base (464)..(464): a, c, t, g, unknown or other
  misc_feature (464)..(464): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtggacaggacccttggtcttccggcgagcgggcttttcacccgtntttatcgttactatgtcagcattcgcacttctgactacctccagcatgccctcacagccacaccttcacagcttacacgaacncctcccctaccaacaacgcaataacgcgtcgctgaccgnacgtctttcgggncctattcggtttacgccccgtctttccaacttcccttcccgcctatctacgacttacg

SEQ ID NO: 342362 - DNA, 709 bp, Homo sapiens
  misc_feature: GZ8MTXP02IRIAJ.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgcaaggcttcgtggagcaccttcagcgatatagttcaagttgggtgcgacgggcctgtggacaggtccttggagtggatgggagtatcgtccctatcgtgacacacaactacgcacagaagtccaggctagacctccaaccacgtaacccggacggaaacctaaaacgttaaaccgaaactaaccgtaagtttaaacgtacccgtaaggggtaacgtaaccttaacggaaaccgtaagggttactacgttactaaacgttccgtaaggaacgggtaccggtaacggggttacctttacccttaacgtttccgttaggtacggtaccggtaagggtaagttaaactttaacgtaaacttaaaccttaccgttaacgttcctttttacccgttttaaccctacccgtttaccccttaagttacccgttcggttccggggtacctaccggttaccggtaacccccggtttccg

SEQ ID NO: 342363 - DNA, 578 bp, Homo sapiens
  misc_feature: GZ8MTXP02IY0OY.17.34.D01.1.454.CMB.2.raw
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagacctccactctctctgtccgtcacacctggacagcccggcctccatcctcctgcaagtctagtcagacgcctcctgcataggtggtagaaaggaaagtaccttcttatatttggtcctgcaggacggccaggccagtcctccacacctctgtactttacgaacgtttccaaccgtcttacgctggactcgccagtagtagttcagtgcagcggtcagggacagtatttacactagaaatcgagcgggtaggaggtcgtagggtagggtacgttagggtaaatttaacgttagttagttagtaggtacgtaaaggtataggtaacgtcctttccgaccggtaccggttacggaccgtaaacgggaccgtaaaggtaacgaaactacgaaaacgtagtacggtcgacgtacg

SEQ ID NO: 342364 - DNA, 385 bp, Homo sapiens
  misc_feature: GZ8MTXP02ISJ8G.17.34.D01.1.454.CMB.2.raw
  modified_base (380)..(385): a, c, t, g, unknown or other
  misc_feature (380)..(385): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacacaagtacagatattaacctgttccatcgactacgccttcgcctcgccttagggtcgactcaccctgccccgattaacgtggacaggaacccttggtcttccggcgagcgggctggcaaggcgcatagnnnnnn

SEQ ID NO: 342365 - DNA, 749 bp, Homo sapiens
  misc_feature: GZ8MTXP02GWNR5.17.34.D01.1.454.CMB.2.raw
  modified_base (240)..(240): a, c, t, g, unknown or other
  misc_feature (240)..(240): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtaggtcgtctcgnagacgtctgaggcgctctcacgactatattacgtataggttggcgcggaccgtctggacgaacgacgtcgtaggtaggaggtaggtaggagtacgtccgtacgtacgtcgtacgaacaaccaaacctaacgaccacaacgaacgtacgtacggacgacacgtacctaccaaaccgtaaaccgaccggaacgaaaacttaaaacgtaacccgaaactaaacgttaaagtaccgttaggaacggactaccggaaagaaacgtccgtacgttacaacctagttaccgacgggaacggtaccggtacggtttaccttaaccggtttcgtacggtaggtaacggtaacggttaaagtttaaactttaactaaacgttaaaaccttaccttaccgtttaccttttaacccctttttaacccgttaacccttcccgtttacgttaaccgtttacccggttccggggtaaacccgttaccgtaaccccggggttaacccccggttaccgtaaccccg

SEQ ID NO: 342366 - DNA, 602 bp, Homo sapiens
  misc_feature: GZ8MTXP02FWT9Z.17.34.D01.1.454.CMB.2.raw
  modified_base (382)..(382): a, c, t, g, unknown or other
  misc_feature (382)..(382): n is a, c, g, or t
  modified_base (482)..(482): a, c, t, g, unknown or other
  misc_feature (482)..(482): n is a, c, g, or t
  modified_base (539)..(539): a, c, t, g, unknown or other
  misc_feature (539)..(539): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaaccagcctacacgcttaaaccgggacaaccgtcgcccggcaacatagccttctcccgtccccccttcgcagtaacaccaagtacaggaatattaacctgttcccatcgactacgccttcggcctcgccttaggggtcactcaccctcgccccgattaacgtggacaggaacccttggtctccggcgagcgggcttttcacccgtntttactcgttacttatgtcagctattcgcacttctgactccctccagcatcgccctacacagccaaccacccttcaacgaggccttaacgaacgaaaccncctaccccctaccaaacaacgcaactaagccgtcgactcgccgcacgtccttcggtnctagttcgtttaccgtcccgtttcaccttcccgttcccgacctactcgtacgtacctacgtcg

SEQ ID NO: 342367 - DNA, 793 bp, Homo sapiens
  misc_feature: GZ8MTXP02HLXQZ.17.34.D01.1.454.CMB.2.raw
  modified_base (215)..(215): a, c, t, g, unknown or other
  misc_feature (215)..(215): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccgcctcatctctncaagtctagtcagacgcctcctgcagtagtagggtaggaaaggaaacgtacctttacgttaattacgtttggttcctgaccgaaggaccgggaccacgggtcccgtaagttccctaccccacctaccccttccgtaggtaacttttaaccggtaaccccgtttttaccccgaaacccgttccgtttccggacgttacggaccgttacgacccgtaaaggtaagtttacgggtttaccgtaagggttcgggaccgtaacggggtccggggtacgaaacggggaacgtaaggttaaatttttaaacccgaaagtttaaacgtaaaaagtcccggaacggggtacccgggggtagggtacgggtaccgtagggttaaggggtaacggttttaggttaaaagtttttagttaacgttagttaagttagaacgttaaaggtaagtaacggtaaccgttccggtttacccgttacccggtaaccgggtttaccgggtaaacccgaaaaccgggggtaaccggtaaaagggttaaccggaaaaccttaaacggaaaaccgtaacgtacgttacggggactaccgg

SEQ ID NO: 342368 - DNA, 580 bp, Homo sapiens
  misc_feature: GZ8MTXP02F1OKT.17.34.D01.1.454.CMB.2.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcatctggggctgaggtgagacgctgggtcctcggtgagggtctcctgcaaggcttcnggaggcaccttnagcactatagtttcaattgggngcgacggcctctggacaaggccttgagtggatggaagntcgtccctatcgttgacacaccaaatccgcacagaacgttccagggcagacctcaccataaccgngaacaaataacganacagtaanctagganctagaaacncgcctagtacactcgtagacggacacgggtcttaccgtacttctgtgacgtagtagtaattacgtactaactactacgttacttaccttttaaccaccctttacccttaacggtacttccgtacggggtaccctacggttacccggtaaaccccggttccg

SEQ ID NO: 342369 - DNA, 597 bp, Homo sapiens
  misc_feature: GZ8MTXP02ILASD.17.34.D01.1.454.CMB.2.raw
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctctggacaaggtcctgagtggatgggaagntcgtccctatcgtgacacaccaaactaccgcacagaagttccgagggcagacctcaaccataaccgcggaaacaaaattaaacgaaacacaagttaatcgtaganctagaactagcctagtcatcgtagacggacacgggtctaccgtacttctgtcgcgaaggtacgtaattactataaacgacttacaccttttcccttttaacctaccctttacccttcgtaaccgtttcgtacgggggtaccctacggttaccgggtaacccccggttaccg

SEQ ID NO: 342370 - DNA, 595 bp, Homo sapiens
  misc_feature: GZ8MTXP02JMI9F.17.34.D01.1.454.CMB.2.raw
  modified_base (322)..(322): a, c, t, g, unknown or other
  misc_feature (322)..(322): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaggacgcctgggtcctcggtgagggtctcctgcaaggcttctggaggcaccttcagcgactatagttcaagttgggtgcgacggcctcgtggacaggccttgagtggatggaagntcgtcctatcgtgacacaacaactaccgcacagaacgtccaggcagactacaaccaataacccgacgaaacaaaattaaaccgaaacaactaagtaatacgtaggagctagaaacagacctagtacattacgaggacggacgacgggtccttacgtacttcgtgtagcggtaaggtataaacttaacgtaataactacttacgtacctttaccttttaccaccctttcctaagtaccttcgtacgggcctacgttacccggaacccgttaccg

SEQ ID NO: 342371 - DNA, 599 bp, Homo sapiens
  misc_feature: GZ8MTXP02HWFLM.17.34.D01.1.454.CMB.2.raw
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacagaatattaacctgttcccatcgactacgccttcggcctcgccttaggggtcactccaccctgccccgtataacgttggacaggacccttggtcttccggcgagcgggtcttttcaccgttctttatcgttacttatcgtcagctattcgctacttcngactacctcancatnccctnacngcacaccttnacagctacacgacncctacccctaaccaacaaccgacacgaacgcgtacgctcgccgcacgtccgttcggtcacgtagtttacgggtttacctccccggtttcaccgttcccgttaccccgcctactcctacgtacctttacgtacccg

SEQ ID NO: 342372 - DNA, 638 bp, Homo sapiens
  misc_feature: GZ8MTXP02IEMEY.17.34.D01.1.454.CMB.2.raw
  modified_base (560)..(560): a, c, t, g, unknown or other
  misc_feature (560)..(560): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacacaagtacaggaatattaacctgttcccatcgactacgccttcggcctcgccttaggggtcactcaccctgccccgataacgtggacacggacccttggtcttccggcgagcgggtctttccacccgtctttactcgtttaccttatgtcagctattcgctacttctgacttccctcacgctactgccctcaacagtaccacctaccctttccaacagggtaccttaacgaacggaaccgtacctaccgacccctaacccaaaccaaccgacaactaacgcgtacgcctagtccgcacgtcgttccgggngtccgtagttcgggtttaaccgtcccccgttttacaaccttcccgttccccgtacctacgttcctacgtacctttacg

SEQ ID NO: 342373 - DNA, 646 bp, Homo sapiens
  misc_feature: GZ8MTXP02HUVG7.17.34.D01.1.454.CMB.2.raw
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggngcgacggcctcgtggacaaggcctttggagtggagtgggaaggntcgtcctatcgttgactacaccaaactaccgcacagaacgttccagggcngactcaccagtaaccgcggaaacaaacgttaaacgaacaacacgttaaancgtaggaagcttacgaacacgccttagtcattcgtagaggtacgtacggggtcctttacgtacgtttctgtcggtacggtaaggtacgttaaaatttaccgttaaattaaaccggtaaccttacggttacccttttaccctttttaacctaaccctttccctttaacggtacctttacggtcggggtaccctacggtaccgggtaacccccggttcccg

SEQ ID NO: 342374 - DNA, 608 bp, Homo sapiens
  misc_feature: GZ8MTXP02H6PF5.17.34.D01.1.454.CMB.2.raw
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgcctgggtcctcggtgagggtctcctgcaggcttctggaggcacttcagcgactatagttcaagttgggtgcgacggcctcgtggacaggccttggagtggatgggagatcgtcctatcgtgacacaccaactcgcacagacgtccaggcngactcaccataaccgcgaacaaataacgaacacagtaactctaganctagaacagcctagacactcgtaggaacggaccgtacgggtacttactacgttccgttaggtacggtccggtaaggtaacgtttaaacttaactaaattaaacctcgttaccgttaccttttacccttttacctaccccttcccgtttaagtacccgtttcgtacggggacctacggttacccggaacccccgttccg

SEQ ID NO: 342375 - DNA, 561 bp, Homo sapiens
  misc_feature: GZ8MTXP02HO7RJ.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcacttcagcgactatagttcaattgggtgcgacgggcctctggacaaggccttgagtggatgggaagatcgtccctatcgttgacacaccaaactaccgcacagaacgttcaggcagactcaccataaccgacgaacaaataaacgaacaacagtaaatctagagctagaacagcctagtactatctagagacgacgggcttactacttcgtagtgacaaggtaagtaaatactaataacactctacttccttttaacaccttaccccttgtacttacgtcgggtacctacgtcgtaaaccccggtccc

SEQ ID NO: 342376 - DNA, 610 bp, Homo sapiens
  misc_feature: GZ8MTXP02GNOCM.17.34.D01.1.454.CMB.2.raw
  modified_base (321)..(321): a, c, t, g, unknown or other
  misc_feature (321)..(321): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (542)..(542): a, c, t, g, unknown or other
  misc_feature (542)..(542): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagttcaattgggtgcgacggcctcgtggacaaggccttgagtggatgggagntcgtccctatcgtgacacaaccaactccgacacagaacgtccgagggcagactcaccaagtaaccgcgaaacaaataaacgaacaacagttaacncgtganctagaacagcctagtcatcgtagacggacgacgggtcttacgtacttcgtcgtcgacggtaaggtagttaaacgttactaacgtaacctacgttacgtaccctttacccgtttttaaccnccctttacccgttaacgtaccgtttaccgtacggggtacctacggtacccggtaaccccggttacccg

SEQ ID NO: 342377 - DNA, 571 bp, Homo sapiens
  misc_feature: GZ8MTXP02IUFZ7.17.34.D01.1.454.CMB.2.raw
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (511)..(511): a, c, t, g, unknown or other
  misc_feature (511)..(511): n is a, c, g, or t
  modified_base (529)..(529): a, c, t, g, unknown or other
  misc_feature (529)..(529): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctccgtgcaaggtcttcgtggaggcacttcagcgactatagttcaagttgggtgcgacggcctgtggacaaggcctgagtggatggaagntcgtcctatcgttnacacaacaactaccncanagagtcaggcagctacaccaacgtaccgacgaacaaacgtaacgaaacactaagtaatacgtagaagtcgtaacgaacacgtacctgtacacttcgtacgaagtaccgacgggtcttacctacgttcgtgtacgacgagtagttaatactataacncgtctactttactttacnccttcctaagtactcgtcggacctacgtccgtaacccgtccg

SEQ ID NO: 342378 - DNA, 594 bp, Homo sapiens
  misc_feature: GZ8MTXP02GR13T.17.34.D01.1.454.CMB.2.raw
  modified_base (283)..(283): a, c, t, g, unknown or other
  misc_feature (283)..(283): n is a, c, g, or t
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtncgacgggcctcgtggacaaggccttgagtggatgggaagatcgtccctatcgttgacacaccaaactccgcacagaacgttccaagggcagacctacgaccataacccgngaacaaattaaaccgaacacagttaancgtaganctagaaacagcctagtcatactggagacacgggtccttactacttcgtgtcgacgtagggtataacttaactaattaaccaactctactttacctttttaccaaccctttcccttcgttaaccttccggtacgggtacccacggttacccggaaaccccggttcccg

SEQ ID NO: 342379 - DNA, 632 bp, Homo sapiens
  misc_feature: GZ8MTXP02H63BY.17.34.D01.1.454.CMB.2.raw
  modified_base (452)..(452): a, c, t, g, unknown or other
  misc_feature (452)..(452): n is a, c, g, or t
  modified_base (486)..(486): a, c, t, g, unknown or other
  misc_feature (486)..(486): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctccgtgcaagggcttcgtggaggcacttcagcgacttatagttcaagttgggtgcggacgggcctcgtggacaaggccttggagtggaagtaggggaagtacgtccgtaccctagttcgttagaccgtaacaaccgaaactacccgcaaacgagaacgttcgagggcagactcaaccactaaccgacgaaactaaaataaaccaaacaactaagttaaacncgtaggaacgtctaacggtaacacgcctgtaccntcgtagaaggacgaccgggtctttacgtacgttcgagtcgtaacgaggtaacgttaaacttacgtaactacctaacgtctacgtttacctttacctaccttcctgttacgtcgttacgggacctacgtaccggtaaccccgtaccg

SEQ ID NO: 342380 - DNA, 632 bp, Homo sapiens
  misc_feature: GZ8MTXP02HBQV4.17.34.D01.1.454.CMB.2.raw
  modified_base (358)..(358): a, c, t, g, unknown or other
  misc_feature (358)..(358): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtgggaggcaccttcagcgactatagttcaagttgggtgcgacggcctgtggacaaggcctgagtggagtggagatcgtcctagtcgttgacacaaccaaactacccgacanacgaagttccgagggcagactacacccaacgtaacccgacggaaactaaaacgtaaaccgaaaccaaacgtaagttaaacgtcgtaaggagtacctaagaaactacgacctagtacaactcgtaggacgacgacgggtacttacgtacttcgtgtcgtacgaggtaagtaacttaactaagttaaaccactacgttaccttaccctttacctacccttccgttaacgtaccttaccggtccgggtacctacggtacccggtaaccccggtcccg

SEQ ID NO: 342381 - DNA, 543 bp, Homo sapiens
  misc_feature: GZ8MTXP02F57EA.17.34.D01.1.454.CMB.2.raw
  modified_base (325)..(325): a, c, t, g, unknown or other
  misc_feature (325)..(325): n is a, c, g, or t
  modified_base (425)..(425): a, c, t, g, unknown or other
  misc_feature (425)..(425): n is a, c, g, or t
  modified_base (507)..(507): a, c, t, g, unknown or other
  misc_feature (507)..(507): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcggacgggcctctggacaagtccttgagtggatgggaagntcgtccctatcgttgacacaaccaaactaccgacacagaagttccaagggcagactcaccaataaccgacgaacaaataaacgaacacaagtaatctganctagaacagacctgtacatctagagacacgggtcttctacttctgtgcgagagtaatactataacactgtacttcctttacncctcctgtactcgtcggccacgtacggacccgtacc

SEQ ID NO: 342382 - DNA, 622 bp, Homo sapiens
  misc_feature: GZ8MTXP02HSQ92.17.34.D01.1.454.CMB.2.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagcgcctgggtcctcggtgagggtctcctgcaaggtctcgtggagcaccttcagcactntagttcaagttgggngcgacggctcgtgacaggcttgngtggatgggaagagtccgtccctattcgtgaaccacacaaactacccgacaacagaacgttcgagggacagactacaacctacgtaaaccgacggaaactaaaactaaacgaaacaacgtagttaaactcgtaggacgtactaggaaactacgcccgtagtcctaattccgtaggaacggactaccgggtcttacgtacttcgtgtagacgaaggtaactaaacttctaaaatacgtacttagtacctttaccctttaccgtaacccttccttaagtccgttacggtcggacctacgttacccggtaccccgttacccg

SEQ ID NO: 342383 - DNA, 648 bp, Homo sapiens
  misc_feature: GZ8MTXP02J2AO5.17.34.D01.1.454.CMB.2.raw
  modified_base (366)..(366): a, c, t, g, unknown or other
  misc_feature (366)..(366): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaagttgggtgcgacggcctcgtggacaaggccttgagtggatgggaagatcgtcctatcgtgacacacaactccgcacagaacgtcaggcngactacaccactaaccgcggaaacaaactaaacgaaacactaagttaactcgtagagctagaacacgaccttgaccatccgtaggacgacgacgggttaccttcgtaacctttcgtaggttcgaggtaacggtaagttaaaactttacgtaaaactaaacctaccgttacgttacccttttacccttttaacccgtaacccctttcccctttaacggtaacccttttacgggtccggggttacccgtaaccggttaccccgggtaaacccccgtttccccgg

SEQ ID NO: 342384 - DNA, 583 bp, Homo sapiens
  misc_feature: GZ8MTXP02FXUCO.17.34.D01.1.454.CMB.2.raw
  modified_base (258)..(258): a, c, t, g, unknown or other
  misc_feature (258)..(258): n is a, c, g, or t
  modified_base (367)..(367): a, c, t, g, unknown or other
  misc_feature (367)..(367): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaggcttcgtggagcaccttnagcgactatagttcaattgggtgcgacgggcctctggacaggccttggagtggagtggagatcggtccctatcgttgacacaccaaactccgacacagacgttcaggcngactcaaccataacccggacgaaacaaattaaacgaaacaacaagttaaactcgtagacgctaggaaccaggacctgtacaatctagacggacgtacgggtacttctacgttctgtcgcgagtagtaattacgtataacacttcgtacttaccttttaccgaccctttcccgttaacgtacttcgtcgggtaccgtacgtaccggtacccgtaccg

SEQ ID NO: 342385 - DNA, 636 bp, Homo sapiens
  misc_feature: GZ8MTXP02JNH87.17.34.D01.1.454.CMB.2.raw
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (325)..(325): a, c, t, g, unknown or other
  misc_feature (325)..(325): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatcgacccagacctccactctctctcgtccgtcacacctggacncgcccggtcctccgtctcctgcaagtctagtcagcgccctctgcagtagtggtagaaaggaaacgtcccttnttaatagtttcggtcctgacaggacggccaggcctacgtcctacccaccnccttctagtactttaacgtacgtttaccccccgaaccgtcttcgctggacctcgacctagtagttaacgggttcgagggttcggacgtacgggccggggtacgaacgggacgaagtactttacgaactacgtaaagaaacgtcgacgggtccggggtagggacggtcgtagggagggttagtttggggtttaggggtttattacgtacgactagtacgtaactaaagtactacgacgtccgttacgtacgttacgtttcggaccgacgggtacaacggtcgtaggaacgaacgtaacgaaacgtacgtacg

SEQ ID NO: 342386 - DNA, 665 bp, Homo sapiens
  misc_feature: GZ8MTXP02F4VEK.17.34.D01.1.454.CMB.2.raw
  modified_base (408)..(408): a, c, t, g, unknown or other
  misc_feature (408)..(408): n is a, c, g, or t
  modified_base (446)..(446): a, c, t, g, unknown or other
  misc_feature (446)..(446): n is a, c, g, or t
  modified_base (550)..(550): a, c, t, g, unknown or other
  misc_feature (550)..(550): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccgcaacatagccttctcccgtcccccttcgcagtaacacaagtacaggaatattaacctgttccatcgactacgcctttcgcctcgccttagggtcactcacccctcgccccgtattaacgtggacacggacccttggtcttccggcgagccgggtctttcgacccgtcttactcgtacttatgtcagtctattcnctacttctagtactaccctcagtcactcgccctcaacncgacaccaccttacaacgtaggtaccttaacgacgtaacccgtaccctacccccaacccaaaacaaaccgtcaaacttaacgcccgtcgccgtacgaccccggntacggtccgtttacgggtctacgttacggttaccggtttaccccgtaccccgtttacctaccgttccccgttacccgtaccttacgttacccgttacgtaaccgttacgttaccg

SEQ ID NO: 342387 - DNA, 688 bp, Homo sapiens
  misc_feature: GZ8MTXP02IU549.17.34.D01.1.454.CMB.2.raw
  modified_base (290)..(290): a, c, t, g, unknown or other
  misc_feature (290)..(290): n is a, c, g, or t
  modified_base (422)..(422): a, c, t, g, unknown or other
  misc_feature (422)..(422): n is a, c, g, or t
  modified_base (511)..(511): a, c, t, g, unknown or other
  misc_feature (511)..(511): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagcgccgtgggtcctcgggtgagggtctcctgcaaggtcttcgtggaggcaccttcagcgacttatagtttcaagttggggngaccggacggtccctcgtaggaaccgtaagggtccttaggagtgggagtaggggaaggtcgttccggtacccttatcggttacgacctaacgaaccaaactacccgacaactagaacgttaccgagggaccnggaacctcaacccgtaacgtaacccggacggaaactaaaacgttaaaccgaaactaacgtaagttaactcgtaggaagtctaagaaacncgtctacgtactaagttcgacggtaggaccgtacgggttaccttacgtacttcgtggtacgtacggaaggttagttaaacttactaacgtaactaccgttagttacctttaccctttactaccctttcgttcgtacgttacggtacggtacctacgttacccggtacccgttacccg

SEQ ID NO: 342388 - DNA, 571 bp, Homo sapiens
  misc_feature: GZ8MTXP02FUAGM.17.34.D01.1.454.CMB.2.raw
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggcaaccgtcgcccggccaacatagccttctccgtccccccttcgcagtaacaccaagtacaggaatattaacctgttcccatcgactacgcctttcggcctcgccttaggggtcactcaccctgccccgataacgtgacaggaccttggcttccggcgagcgggctttcgaccgtnttatcgttacttactgtcagctatcgcacttcngactcctcagtcatcncncacacncactacctacacacgtactacacgaccacctacccctacccaacaacacacacgtacgtcgcgtcgcgcgacgtcgtcgtcgtcgtacgttacgttacgtccgttctactccgtccgtacctctctacgtactacgtcg

SEQ ID NO: 342389 - DNA, 623 bp, Homo sapiens
  misc_feature: GZ8MTXP02IVOTG.17.34.D01.1.454.CMB.2.raw
  modified_base (282)..(282): a, c, t, g, unknown or other
  misc_feature (282)..(282): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctggtgagggtctcctgcaggcttcgtggaggcaccttcgagcgactatagttcaattgggngcgacggcctcgtggacaaggccttgagtggagtgggaagatcgtccctatcgtgacacacaaactaccgcacagacgtacagggcagctacaccgactaaccgacgaaacaaactaaacgaacaataacgttaatcgtagagtactaagaacagactgtactactactagggacgacgtacgggtcttaccgtactttcgtaggtcggacggtaagttaacgttaaactttaacgtaacgttaaacacttacgttcctttaccgttttaccacccctttacgttaacgtttaccgttcggttacgggtccctaacggttaccggtaacccccggtttacc

SEQ ID NO: 342390 - DNA, 569 bp, Homo sapiens
  misc_feature: GZ8MTXP02I0JO1.17.34.D01.1.454.CMB.2.raw
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
  modified_base (513)..(513): a, c, t, g, unknown or other
  misc_feature (513)..(513): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctntggacaaggccttgagtggatgggaaggatcgtccctatcgttgactacaccaaactaccgcacagaacgttcaggggcagctcaccataccgcggaacaaattaacgaacacaagttaanctaggagctagaacagcctgtcatctgaggacacgggtccttctacttctgtgcgtaggagttaattactataaccacttcacctttacctttaccncccttacccttgtacccttacgtacggggtcctacgttccggaaaccccggtttcc

SEQ ID NO: 342391 - DNA, 840 bp, Homo sapiens
  misc_feature: GZ8MTXP02HKBJO.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcgtgcaaggcttcgtggaggcaccttcagcgactatagttcaagttgggtgcgacgggtcctcgtaggacaaggtccttggagtggagtaggggaaggtacgtccggttcccctaagttccggtttacgaaacccaaccgtaacccgtaaaaaccgttaccccggaccaacgaacggtaaacggtttacccgaacggggtaccaacggaccttacccgaaaccccgtaacgttaaaaccccgggtaccggggaaaaccttaaaaaccggttaaaacccgaaaacccgtaaacccgttaaaacggtttaaacgttacccgtttaggggaaacgtacccgttaaagtaaaacccgacgtaccccgttagggttaccctaacgttaccggttaacgggtaaccgggaaccggtaacccgggggtttacctttacccgtttaaccgtttaccgtgggttacggaccgggtaagggtaacgttaaaacgtttaacgtaacgttaaacctaccttacggttacctttacccgtttttaacccacccgtttacccttcggttaaccttcgggtaccggggaccttacggtaccggtaaacccccgggtttcccg

SEQ ID NO: 342392 - DNA, 611 bp, Homo sapiens
  misc_feature: GZ8MTXP02IZTZD.17.34.D01.1.454.CMB.2.raw
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
  modified_base (404)..(404): a, c, t, g, unknown or other
  misc_feature (404)..(404): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgcctgggtcctggtgagggtctcctgcaggcttcgtggaggcaccttcagcgactatagttcaagttgggtgcggacggcctcgtggacaggccttgagtggatggaagntcgtcctatcgtnacaccaacaactccgacacagacgtcaggcngactacaccacgtaaccgacgaacaaaactaacaacaanagtaactcgtagacgactagaacacgcctacgtacgtatcgtaggacggaaccgtacggggttaccttccgttacgtttacgtggtcgacggtaaggtagttaaacttacgtaacttacgtacttgtacccttttactttacctacccttcctttaacgtactttaccgtcggggtacctaccggttaccggtaaccccgtttcccg

SEQ ID NO: 342393 - DNA, 573 bp, Homo sapiens
  misc_feature: GZ8MTXP02IB6QV.17.34.D01.1.454.CMB.2.raw
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
tcagcgtagactagcacgaccggtgctcgatttagatcgtctgtgttgggtttgggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctccgtgcgaaggcttcgtggagcctaccgttcagcgacttatagttcaagttggtcgcgacggtcctcgtggacaaggccttagagtggagtggaagtctcgtcctatcgtgacacaccaatccgcanagacgtcaggcagactacaccagtaaccgcgaaacaaataaacgaacaactagtaatcgtagancgtagaacgacgctagtacatactagagacgtcggacttcgtactcgtgtcgacgtagtagtaactactaataccgtatcgttactttacctttacacccttccgttaacgtaccgttcgttacggacctacgtaccggtaaccccgtccg

SEQ ID NO: 342394 - DNA, 616 bp, Homo sapiens
  misc_feature: GZ8MTXP02GYGXR.17.34.D01.1.454.CMB.2.raw
  modified_base (351)..(351): a, c, t, g, unknown or other
  misc_feature (351)..(351): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtgggtagaaaggaaagacctttctatatttggttcctgcagaggccaggccagtcctccacacctctgatttacgaacgtttccaaccgtctcgctggactgcagntagttcagtggcaggcgggtacgaggggacagtattttaacactaagtaaaactacgacgggccggggtaggggaggtacgtagggtaagggtacggtttaagggtaaattttaagttaagttgtagttacggagtaaagggtataacgtaacgtccgttacccgtaccggtaaccggtttacgggacccgaaaaggggaacccgtaaaaggggtaacggtaaaaccgaaccgtaaaaacggtaaccgtggtacggggtctaccg

SEQ ID NO: 342395 - DNA, 790 bp, Homo sapiens
  misc_feature: GZ8MTXP02IEL29.17.34.D01.1.454.CMB.2.raw
tcagcgtagactagcacgaccggtgctcgatttagatcgtctgtgttgggtttggggatcacaaaaacaaccagattcctcctctaaagaagcccctgggagcacagctcatcaccatggactggacctggaggttcctcttttgtggtggcagcagctacaggtgtccagtcccaggtccagttggtgcaatcgtggggctggaggtagaagacgccgtgggtcctcgggtgagggtctccgtgcaaggtcttcgtggacggccaccgttcagcgactatagtttcaagttgggtgcgacggtcctctaggactaggcctgagtggagtgggaaggctcgtacctatcgtagaacacaccgtaaactccgacacgacgacgttaccgacggcacgactaccgaaaccacgtaacccgacggaaaactaaataaacgaaacaactaagttaactacgtagacgtacgtacgaaacgacggtccctaggtaccctaagttacccggtaggaacgggtaaacccggttccggggttacctttacccttaaaccgtttcccggttagggtacggtacccggttaaaacggggtaacgttttaaaagtttaaaccctaaaaggttaaaacccgttaacctttaaccgggtttacccctttttacccgtttttaaaacccccgtttaaccccctttaacccccgttttaagggtttaaaccccgtttttaaccggttaccgggggttaaccctaccccgggttttaaaccggggaaacccccccggtttaccccg

SEQ ID NO: 342396 - DNA, 580 bp, Homo sapiens
  misc_feature: GZ8MTXP02GET1T.17.34.D01.1.454.CMB.2.raw
  modified_base (332)..(332): a, c, t, g, unknown or other
  misc_feature (332)..(332): n is a, c, g, or t
tcagcgtagactagcacgaccggtgctcgatttagatcgtctgtggttggggtttggggactgatcaggacttctcagttcatcttctcaccatgaggctccctgctcagctcctggggctgctaatgctctggatacctggatccagtgcagatattgtgatgacccagactccactctctctgtccgtacaacacctggaaccagcccggtccctccaattcctcctgaccaagtcctaagtcaagagcctcctgcatagtggtagaaaggaaagtaccttacttataatttggttaccctgcgaagacgggcccaaggccctagttccncctaacacctcctagtaacttttaacggaactttacccaaccgtcttacgctaggaacctggacccaagtaataggttcaagtgggccaagcggtcaggacaagtatttacatagaaaatcagaccggtgaggctagagtacgttaggtaattattactgtatgagaaggtataggactcgtccgtcgacgttcgaccgaacggacgaacgggaaggaaactacgaaaacgacgtacgtaggctacgg

SEQ ID NO: 342397 - DNA, 751 bp, Homo sapiens
  misc_feature: GZ8MTXP02JGFKY.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggacctggacctggaggttcctctttgtggtggcagcagctacaggtgtccagtcccaggtccagttggtgcaatcgtggggctggaggtgaagacgccgtgggtcctcgggtgagggtctccgtgcgaaggtcttcgagggacggtctacccttcaggtaccgaacttagttacgttcgaaagtttcggggcgccggaaccggcccttacgtggaaccaaagggtcctttggaacgttggatggggaagtctcgtacccgtgtcgttagacaccaacgaaactccgacacgacgtaagtcccgaagggtcaggtacctacgtacccaaacgtaacccgacgaaaactaaacgttaaaacgaaaccaactaacgttaaatcccgtagtacgacctaggaaacctacgacctcgtactaagtcgtaacggacggtaccgtacgggttaccttaccgttaacttcgttcggtacggtaccggttaaggtaaacgtttaaacttaaacgtaaccgttaaacgtaaccggttacgtttacccgtttaacccttttaaacccgtccccgtttaccgtttaacgttaccgttcgggttaccggggtaccctacggttacccggtaacccgtttaccccgg

SEQ ID NO: 342398 - DNA, 626 bp, Homo sapiens
  misc_feature: GZ8MTXP02GM66K.17.34.D01.1.454.CMB.2.raw
  modified_base (275)..(275): a, c, t, g, unknown or other
  misc_feature (275)..(275): n is a, c, g, or t
tcagcgtagactagcacgaccggtgctcgatttagatcgtctgtgttgggtttggggactgatcaggacttctcagttcatcttctcaccatgaggctccctgctcagctcctggggctgctaatgctctggatacctggatccagtgcagatattgtgatgacccagactccactctctctgtccgtcacacctggacacgcccgccccatctcctgcaagtctagtcagacgccctctgctagtaggtggtagaaagggtaaactaccctttnttaatacgtttgggttccctaggccgaaggacggccaggtcccaagttcctacccaacctaccttcctagtaatttaaccggtaacgtttcccccaacgtcttacgctggaccttgcctagtacgttacggttcaggtggacgaggcgggtcgaagggacagtactttacagttagaaaatcgagggccggtggacggctagggaggtacgttaggtaaatttagtacttaggtatagagtaagtagtacgtaacggtcttacccgacggtaccggttacggaccgaaacgggtaaccgtaagggtacgaaacgtaccgtaaaacgtaccgtggtaccggacgtacgaccg

SEQ ID NO: 342399 - DNA, 607 bp, Homo sapiens
  misc_feature: GZ8MTXP02F5LQZ.17.34.D01.1.454.CMB.2.raw
  modified_base (260)..(260): a, c, t, g, unknown or other
  misc_feature (260)..(260): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttnagcgactatagtttcaattgggtgcgacgggcctcgtggacaggccttgagtggagtgggaagatcgtccctatcgttgacacaccaatccgcacagatcgaggcngacncacataaccgcgaacaaataacgaacacagtaatctagancctagaacagactagtacagtcgtacggacggacgtacggggactttaccgtacttcgtggttacgacggtaaggaaagttaaacttactaaactaacgtacttacgtacctttacccttttaaccaccctttacccttaaggttaccttacggtacggggaccctaacggtttacccgggaacccccgtttcccgg

SEQ ID NO: 342400 - DNA, 625 bp, Homo sapiens
  misc_feature: GZ8MTXP02JB8XM.17.34.D01.1.454.CMB.2.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttcgtggaggcaccttcagcgactatagtttcaattgggtgcgacgggcctctggacaaggccttgagtggatgggagntcgtccctatcgttgacacaccaactaccgcacagaacgttccagggcngactcaccanaaccgngaacaaataacganacagtaatcagancagacagcctgtacatcgtacgacgacgacgggtacttccgtacttccgtaggttcgaccggtaaggtaacgttaaactttaacgtaaacgttaaactaaccgttacgtaccctttaccctttttaacctaccccgtttaccccgtttaacgttaccgtttacggttaccggggaccctaccggttacccgggtaacccccggttaccccg

SEQ ID NO: 342401 - DNA, 621 bp, Homo sapiens
  misc_feature: GZ8MTXP02GBSZT.17.34.D01.1.454.CMB.2.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatcgtgggctggaggtgaagacgccgtgggtcctggtggnggtctctgcagctgnggngcactnagcgactatattcagttgggngcgacggctgtgacaggctgagtggagtggagngtcgtccgtntcgtnacaccaacaactccgacacagacgttcgacggacncgtacctcaaccacgtaccgagtaaactaaacgttaaacaacaaatagttaactacgtaggacacgtagaacctagtctcgtacagttcgacggaggaccgtacgggtacttacgttacttgacgtggacgtagtaaagtttacgtaacttaaactacttcgttaccgttacctttttcccttttaaacccgtccctttaccgttccggttaccgttcggttacgggtaccgttaccgtacccggttacccccgttaccccgg

SEQ ID NO: 342402 - DNA, 739 bp, Homo sapiens
  misc_feature: GZ8MTXP02FIZDN.17.34.D01.1.454.CMB.2.raw
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctccgtgcaaggtctcgtgggagcaccttnagcgtactatagttcaagttgggtgcgacgggcctcgtggacaaggccttgagtggatggggaagntacgtccctatcgttacacacgaaaccaaactcccgacaacaagtacgttacccgaggggtacacgacctaccaaccgtaaacctaaacccggacggaaaacctaaaaacgttaaaaccgaaactaaacccgtaaaggtttaaacctacgttaacgggacgaccgttaagaaaacgtaccggtaccttacggtaccctaagtacgttacggacgggaccgtaacccggggttacctttacctaacgtttccgtaggttacggaacggtaacgggtaaggttaaaacttaaacgttaacttaaacctaccgttacgttaccctttaccctttttaaaccctccctttaccccgttaagtacccgtttcggaccgggttaccgtaccggttaacccgggtacccccgttacccg

SEQ ID NO: 342403 - DNA, 543 bp, Homo sapiens
  misc_feature: GZ8MTXP02I63MX.17.34.D01.1.454.CMB.2.raw
  modified_base (180)..(180): a, c, t, g, unknown or other
  misc_feature (180)..(180): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (524)..(524): a, c, t, g, unknown or other
  misc_feature (524)..(524): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctccgtcccccttgcagtaacacaagtacagaatatacctgttccatcgactacgccttcggcctcgccttaggggcactcaccctgccccgtattaacgtgacaggaccttggtctcggcagcggtctttcaccgtnttatcgtactangtcancattcgntactctnactcctcagcatgcctcacancacacctcacagctacagaacncctacccctacaacacgacagaacgcgtcnctcgaccncacgtcttcggntcgtagttcgttaccgcccgttcactccgtcccnctactctacgtactacgtc

SEQ ID NO: 342404 - DNA, 569 bp, Homo sapiens
  misc_feature: GZ8MTXP02HSMXW.17.34.D01.1.454.CMB.2.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagcgtagactagcacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgacttaaaccgggacaaccgtcgcccggcaacntacgccttctccgtccccccttgcagtaacacaagtacagaatattaacctgttcccatcgactcgccttcgcctcgcctagggtcactcacctgccccattacgtgacagaccttgctcgngagtggctttcgccgtnttatcgtactntntcntcnttgctgttctgctacctcgancatctcctacacacacactaccttcacgacgactacacgaaccaccctacccctaacccaaccaacgacacaacgcgtccgcgcgccgcgacgtcgtcgtcgtacgtacgttacgttccgtcccgttcctaccttcccgttccctacctactccgtacgtactacgtcg

SEQ ID NO: 342405 - DNA, 646 bp, Homo sapiens
  misc_feature: GZ8MTXP02JBS50.17.34.D01.1.454.CMB.2.raw
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggagtgggaaggatcgtcctatcgttgacacaccaaactaccgcacagaagttccgagggcagacctacaccagtaaccgcggaaacaaacttaaacgaactaactaagttaactactaggagctagaaacacgacctgtacactcgtagaggacgacggggtaccttaccgttaacttccgttggtcgtaccggtaagggtagttaaacgtttaacctaacttaaaccacgttacgtaccctttacccgtttttaaccacccctttccccgttaacgtacccgtttaccggtcgggggtaccctaccggttaccggaaacccccgggtttcccg

SEQ ID NO: 342406 - DNA, 716 bp, Homo sapiens
  misc_feature: GZ8MTXP02FJQVD.17.34.D01.1.454.CMB.2.raw
  modified_base (470)..(470): a, c, t, g, unknown or other
  misc_feature (470)..(470): n is a, c, g, or t
  modified_base (492)..(492): a, c, t, g, unknown or other
  misc_feature (492)..(492): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctgaggtgaagacgccgtgggtcctcggtgagggtctcctgcaaggtctcgtggaggcaccttcagcgtactatacgtttcaagttgggtagcggacggcctcgtggaacaaggtccttggagtggagtggggaagtatccggtaccctgtcggttacgaaccacaaaccctaaactacccgacaacgaacggtaacgttacccgaaggctagacctacaaccgaacgtaacccgacgtaaactaaaacttaaacgaaactaataagttaanccgtaggaacgctaagaaaccncgtacccgtagtacctatcggtacggagggaaccgtaccgggtacttaccgttacgttcgtggtacgacggtaagggtaagttaaactttaaacgtaacgttaaaccttacgttaccttaccttttacccctttttaacctaccccgtttaccgttaaccggttacctttaacccgggtcgggacccgttaacggtaaccccgggtaaccccggtttacccccg

SEQ ID NO: 342407 - DNA, 778 bp, Homo sapiens
  misc_feature: GZ8MTXP02FOX0E.17.34.D01.1.454.CMB.2.raw
  modified_base (258)..(258): a, c, t, g, unknown or other
  misc_feature (258)..(258): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctgggctgaggtgaagacgcctgggtcctcggtgagggtctcctgcaaggcttcgtggagcaccttnagcgactatagtttcaagttgggtgcgacggcctcgtggacaaggccttgagtggatgggaagatccgtaccctagtcgttagaaccacaccaaaactcccgacaacgagaacgttccaaggggccaggacctaccgtaaacccaacgttaaaccccggacgggaaactaaaaagtttaaacccgaaactaaaccctaaagggtttaaactaccgttaaggggtaaacgaccgttaacgtaaaaccgacgggtaccccttagtacctaacgtttaccgtacgggaaaccgggtaaccggaacccggggtttacctttcccggttaaactttcccggttagggttacggaccgggaaaggttaagttaaaactttaaaccggttaaactaaaccgtaaccgtttcgtaccctttttaacccccgttttaacccaccccggttttaccccttaagttaaccccgtttccggtaccggggtaacccctaacggttaccccggtaaaacccccggtttaccccg

SEQ ID NO: 342408 - DNA, 739 bp, Homo sapiens
  misc_feature: GZ8MTXP02F433F.17.34.D01.1.454.CMB.2.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
  modified_base (481)..(481): a, c, t, g, unknown or other
  misc_feature (481)..(481): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttnagcgactatagtttcaaattgggngcgaccggcctcgtggacaaggtccttgacgtggatggggaaggntcgtccctatcgttcgacacgaccaaactacccgctaccgagtaacgttccgacgggtcagacctacgaccactaacccggacggaaactaaacttaaaaccgaaactaaccgtaaattaaacgcgttaggaacggtcttaacgaaaccgtanaccccgtattaacgacttacgttagggaacggtaccggtaaccggggtctttaaccgtacgtttacccgtgggttaccggagggttaacggtaacggttaaactttaaaacgtaacgttaaaccgttactaccggtttaccccttttacccgtttttaaacccgtccccttttaaacccggttccgttaaaccgtttcccgggtaccggggtaccccgtaacgggtttaccccgggtaaacccccccgggtttaaccg

SEQ ID NO: 342409 - DNA, 705 bp, Homo sapiens
  misc_feature: GZ8MTXP02INDAE.17.34.D01.1.454.CMB.2.raw
  modified_base (253)..(253): a, c, t, g, unknown or other
  misc_feature (253)..(253): n is a, c, g, or t
tcagcgtagactagcacgaccggtgctcgatttagatcgtctgtgttgggtttggggatcacaaaaacaaccagattcctcctctaaaagaagcccctgggagcacagctcatcaccatggactggacctggaggttcctctttgtggtggcagcagctacaggtgtccagtcccaggtccagttggtgcaatctggggctggaggtgaagcgccgtgggtcctcgggtgagggtctccgtgcaggtcttcgnggagcaccttcgagcgacttatagttcaagttgggtgccggtacggtcctgtcggacgaaggtccttggtacggtggtagtaggggaagtacgtcgttaccctagtcgttcgaacctaccaaaccaactccgacaacaggtacttaccgagggcaggacctacaacccgtaacgtaacccgacggtaaaacctaaaacgttaaacgaaacgaaacgttaaagtaaaacgtcgtaagggaacgtcgtaacggaactacgtcctacgtactacgttacgtacggtaacggaccgtacgggtaccctttcgttacgttccgtggtacggtaccggtaagtaaacgttaacttaactaacgtaaactcctacgttacctttaccgtttaacctcccttaccgtttcgtaccgttcggtacgggtaacctacggtacccggtaacccggttaacccg

SEQ ID NO: 342410 - DNA, 735 bp, Homo sapiens
  misc_feature: GZ8MTXP02IORC5.17.34.D01.1.454.CMB.2.raw
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctcctgctaggcttcgtgggacggctaccttcgacgcgtacttatagttacgtaagttgggtcgccggacgggtcctcgtacggaacgaacggtccgtttagggaggtaggagtaggggaaacgtcgtaccgttcccgtagtttcgtacgaaccaactaaacccgaaactaccccgacaacgacgtacgttccgaacgggcacgactaccaaccctaacgtaaccggacgaaactaaacgtaaaccgactacgtaataactcgaggtaancttaggaaacncggtaccctagtacctagtacggtacgaggtacgtaccgggttacctacgttaccgttcgtgggtacgtcggtacggttaaattaaactttacgaaaactttaaacctctttaccggttaccctttttaacccttttaaccctcccttaccgtttaacgtaccgtttcgggtacccggggtacctacccgggtttaaccccggacccggtttaacccccg

SEQ ID NO: 342411 - DNA, 582 bp, Homo sapiens
  misc_feature: GZ8MTXP02IUDEI.17.34.D01.1.454.CMB.2.raw
  modified_base (375)..(375): a, c, t, g, unknown or other
  misc_feature (375)..(375): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgccgtgggtcctcggtgagggtctcctgcaaggcttcgtggaggctaccttcagcgactatagttcaagttgggtgcgacgggcctcgtggacaaggccttgagtggagtgggaagctcgtccctagtcgtgacacaccaaactccgcacagaacgtcgaggcngactcaaccgataaccgcgaaactaaataaaccgaacaactaagtaatcgtagacgctagaacagcctagtacactcgtagacgacgacgggtcttacgtacttcgtgtcgacgaggtataacttactaactaactactacgtcctttacctttaccacccttccgttcgtacttcggtcggacctacgtaccggtacccgtacccg

SEQ ID NO: 342412 - DNA, 693 bp, Homo sapiens
  misc_feature: GZ8MTXP02IBTCG.17.34.D01.1.454.CMB.2.raw
  modified_base (343)..(343): a, c, t, g, unknown or other
  misc_feature (343)..(343): n is a, c, g, or t
tcagcgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtgagggtctctgcaggcttcgtggaggcctaccttcgagcgactatagtttcaagttgggtgcgacggcctcgtggacaaggtcctgagtggagtgggaaggtactcgtaccctntcgttgacacaccaactacccgacacagtacgtcgaggacagactcaaccactaacccgagaaactaaaacttaaacgaaacacgtaagtaactcgtagggacacgtagaaacacgaccgttgtactacgttaccgagggaaccggaccgtaccggggtcctttaccgttaccgttgttacggtcgacgggtagttaaaagttaaactttaaacgttaaacttaaacgaccgtttacgttacccttttaccctttttaacccgttacccttttacccgtttaagttacccgtttaccgggttccgggtacccgtaaccggttttacccgggaaacccccgggtttacccg

SEQ ID NO: 342413 - DNA, 693 bp, Homo sapiens
  misc_feature: GZ8MTXP02HL252.17.34.D01.1.454.CMB.2.raw
  modified_base (281)..(281): a, c, t, g, unknown or other
  misc_feature (281)..(281): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctggtgagggtctcctgcaaggcttcgtggagctaccttcagcgactatagttcaattgggngcgacggcctcgtggacaaggccttgacgtggagtgggaaggtntccgtcctatcgttgacacacaaacncacanagacgtcgaggcngactcaccataccgcgaaacaaactaacgaacactagtaactcgtagacgacgtanaaacgacgtcctaggttacaacgtacgtacggtaacgggaccgtacccggggttacctttccgttaaccgtttaccgtgggttacggtaaccgggtaacgggggttaaacttaaaactttaaccgttaaaactaaaccgttaccgttacgtttacccctttaacccgtttttacccctaacccttttaccccggttaacgttcccgtttaccgggtaccggggtaccccgttacggtacccccgggggtaaaccccgtttacccccgg

SEQ ID NO: 342414 - DNA, 774 bp, Homo sapiens
  misc_feature: GZ8MTXP02JXSLB.17.34.D01.1.454.CMB.2.raw
  modified_base (254)..(254): a, c, t, g, unknown or other
  misc_feature (254)..(254): n is a, c, g, or t
tcagcgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatcgtggggctggaggtgaagacgccgtgggtcctcggtggagggtctcctgacaaggtcttcgnggaggcctaccttcaggcgtactattagttcaagttgggtgcggacggtcctcgtggaacaaggtccttggaggtggagtaggggaaggcgtccgtaccctagttcgtcgaaccaacacctaaaacgtcccgacacgaagtaacgttccgaaggggtacacgtacctacaaccgtaacgaaccgtacggaaactaaaacgttaaaccgaaactaaactaaacgttaacgtaccgtagggaacgtaccgtaacgaacgtaccgtacgtacgttacacgttacggtacggtacggtaaccggtacccggggttacttaccgttaccgtttcgtacgggttacgaccgggtaaaggtaaaccgtttaaaactttaacgttaaaaccgttaaacgtaacgtttaccgttaccccgtttttacctttaaccccttaaccccgtttaccgtttaaccgtaaccggtttccggtaaccggggttacccgtaaccggttaccccgggttaacccccggtttaaccccg

SEQ ID NO: 342415 - DNA, 692 bp, Homo sapiens
  misc_feature: GZ8MTXP02H7T5Z.17.34.D01.1.454.CMB.2.raw
  modified_base (150)..(150): a, c, t, g, unknown or other
  misc_feature (150)..(150): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (493)..(493): a, c, t, g, unknown or other
  misc_feature (493)..(493): n is a, c, g, or t
tcagcgtagactagcacgaccggtgctcgatttagatcgtctgtgttgggtttggggactgatcaggacttctcagttcatcttctcaccatgaggctccctgctcagctccgtggggctgctaatgctctggatacctggatccagtgnagatattgtgatcgaccagacctccactctctctgtccgtcacnctgacncgccgtctcatctcgtnactaagtcagtacacgcgtccctcagtcagtaggtggagaaaggaacttcttacgttatagttacgtctgacgagacgcgacgcctacgtcctacctactaccctcgtacgtatttaaccggtaccttacccaaccgttcgtcgtcgtacggtacgtcgacctaaggtagttacgttcgacggtcggaccggaccggggtcggggaccgaaaggggtactacggttaacgttttaacgaaacggttaaacttaaacgcgggtaggttacccggggngggaggtaaccgtggggttaaacggttcgggttaagttaacgtttaacttaacggtacggttagtacggtaaccgaaaggttagttaacggtcgttacccgttttacccgggaccgttaccggggttaccgggttaaccgaaaacggggtaccgtagggtaaaccgtacaaccgtaacgaaggtccgtacgggctaacg

SEQ ID NO: 342416 - DNA, 495 bp, Homo sapiens
  misc_feature: GZ8MTXP01CMF1L.51.14.B03.1.454.CMB.2.raw
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
tcagcgatcgtatacacgaccggtgctcgatttagtgtgagtagttcgcgggcacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcatgccaaaccgatatgcttattggtaccagcagaagccgggccaggcccctgtgttggtgatgtataaagacacctgagagccctcaagggatccctgagcgatctctgctccaggtcagggacaacggtcacattggccatcagtggagtccgaggcagaggacgaggctgactattatgtcaatcaacngacactatgttacttattgtntcgaactgcgacaaggttcaacccg

SEQ ID NO: 342417 - DNA, 569 bp, Homo sapiens
  misc_feature: GZ8MTXP01EK4PC.51.14.B03.1.454.CMB.2.raw
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcatgccaaaccgntatgcttatggtacagcagaagccggccaggcccctgtgttggngatgtataaagcacctgagaggccctcgaagggactcccgtgaacgcgtatttcctcgtcgggccttcccgaggtcgaaggggacaacgggtcaacctagttcggcccaatcaaggttggacgtccggaggcaggaggacgaggctgacttatattgtcaatcaaacagaaccttaccgtaagtttcggttaactttattcgttaacttcgggaaacttcggaccgaccgtaaacgggttcctaaccccggg

SEQ ID NO: 342418 - DNA, 513 bp, Homo sapiens
  misc_feature: GZ8MTXP01BZYOA.51.14.B03.1.454.CMB.2.raw
  modified_base (254)..(254): a, c, t, g, unknown or other
  misc_feature (254)..(254): n is a, c, g, or t
  modified_base (315)..(315): a, c, t, g, unknown or other
  misc_feature (315)..(315): n is a, c, g, or t
  modified_base (475)..(475): a, c, t, g, unknown or other
  misc_feature (475)..(475): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccacctcggtgtcagtgtccccaggacagacgccaggatcacctgctctgganatgcatgccaaaccgatatgcttatggtaccagcagaagccggccaggcccctgtgttggngatgtataaagcactgagacgccctgaagggatccctgacgcgattctctgggcctcgagtcgaagggacaacggtcaacagttggaccatcgagtggacgtccgaggcagaggacgagctgacttatatgtcaatcgaacagacacgattggttacttnttgtcttacggaactgcgacctaaggttccgtaaccgg

SEQ ID NO: 342419 - DNA, 604 bp, Homo sapiens
  misc_feature: GZ8MTXP01DDTPA.51.14.B03.1.454.CMB.2.raw
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcatgaccaaacgntatgcttatggtacagcagaagccggcaggcccctgtgttggngatgtaataaagacactggagcgccctgaagggactcccgtgacgtcgtattcctcgtcggcctaccgaggtccgaaggggaacaacgggttcaacgtacgttcggacctagtcgaggtaggacgtccggaaggcgaaggacgggacgaaggtcgtaggtaacttattagttacgtacaaacgtaacaaacgacgtaaaccacctaagtttacggttaaccttgttacgttaaccgttaacggtaaccgttggacccggttaaccgtaacggggttccctaaccccggg

SEQ ID NO: 342420 - DNA, 599 bp, Homo sapiens
  misc_feature: GZ8MTXP01C50JX.51.14.B03.1.454.CMB.2.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcatgaccaaaccgatatgcttattggtaccagcagaagccggcaggcccctgtgttgngatgtanaaagacactgagcggccctgaagggactcccgtgagcgtattctctggctcgaggtcagggacaacggtcactagttggacccatacaggtacgggacgtacccggaagggccgaagggacgggaacgagggtctaggtaacttaagtttagttacgtaccaaattaaccaaacgacggtaaccaaccgttaagtttcgggttaaactttgttacggtttccgttaacgggtaacttcggaccgttaacccgtaaaggttcccgttaaccccggg

SEQ ID NO: 342421 - DNA, 588 bp, Homo sapiens
  misc_feature: GZ8MTXP01BETAL.51.14.B03.1.454.CMB.2.raw
  modified_base (334)..(334): a, c, t, g, unknown or other
  misc_feature (334)..(334): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcatgaccaaacgatatgcttatgtaccagcagaagccgggcacggcccctgtgtttggtgatgtaataaagacnctgagaggccctgaagggactccctgagcgtattctcgtggccttcccgagggtacgaacgggactaaacgggtcaacgtagttcgggaccctagtaccgaggttagggacgttaccggaggccgaagggagggacgaggctaggtaacttattattgactaaataactaaacagtaaccaccgtagtttacggttactttacttgtaacctttacgggaacttcgaccggacctaacggttccgtaaccccgg

SEQ ID NO: 342422 - DNA, 541 bp, Homo sapiens
  misc_feature: GZ8MTXP01D4AVU.51.14.B03.1.454.CMB.2.raw
  modified_base (255)..(255): a, c, t, g, unknown or other
  misc_feature (255)..(255): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgcaggatcacctgctctgganatgcatgaccaaaccgatatgcttatgtaccagcagaagccggcacggccctgtgttgtgatagtaataaagacacctgagacgccctacgaagggtactcccgtgaagtcgtaacttctcgtggcctacgagtcgaaggacaacggtcacagttcgccatcgagtgactcggagcaggagacgngcagtactnttagtntacaataacaaanacacaacctagttcggttaaccttnttcgttaacgtacgtaacgtgaccgaacgtaacgttcgtaaccccggg

SEQ ID NO: 342423 - DNA, 532 bp, Homo sapiens
  misc_feature: GZ8MTXP01COMKJ.51.14.B03.1.454.CMB.2.raw
  modified_base (377)..(377): a, c, t, g, unknown or other
  misc_feature (377)..(377): n is a, c, g, or t
  modified_base (476)..(476): a, c, t, g, unknown or other
  misc_feature (476)..(476): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcatgaccaaaccgatatgcttattgtaccagcagaagccgggccacggcccctgtgttggtgatagtaataaagacacctgagacggccctcgaagggactcccgtgacgcgtattcncgtggctccgaggtcgagggacaacggtcagtacgttcggacctatcgagtggacgtcgaggcgagaggacgaggctagactattatgtacaatcaacngacactagttgttacttgttgttctacggaactgcgacgtaacggttctaacccgg

SEQ ID NO: 342424 - DNA, 622 bp, Homo sapiens
  misc_feature: GZ8MTXP01CDS2F.51.14.B03.1.454.CMB.2.raw
  modified_base (258)..(258): a, c, t, g, unknown or other
  misc_feature (258)..(258): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgganatgcatgaccaaaccgatatgcttatggtacagcagagccggcaggcccctgtgttgtgatgtaataaagcactgagacggccctacgaaagggactccctgggacgtcggtattcctcgtacgggcctccgagggtcacggggaacaaacggttcaactattcggaccattcgaaggtgggacgtccggagggaccgaaggacgggaacggaggctaggtaaacttagtttaattacggtacaaattaacaaacacgaaaccaacccgttaagtttacggtttaacctttagttacgggttaaccgtttacgggtaaaccgttcgggaaccgaacccgtaaaacgggttcccgtaaccccggg

SEQ ID NO: 342425 - DNA, 560 bp, Homo sapiens
  misc_feature: GZ8MTXP01BQS0D.51.14.B03.1.454.CMB.2.raw
  modified_base (272)..(272): a, c, t, g, unknown or other
  misc_feature (272)..(272): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcatgaccaaaccgntatgcttattggtaccagcagaagccggccaggcccctggtgttggtgatgtaataaagacacctgagacggccctgaagggactcccgtgacgcgtattctcgtgggtctccgaggtcagggacaacggtcacctagttcgccatcgagtgacgtccgaggcaggaggacgaggcctagacttattagttgtaccaataacaaacgagtaaccaccgtaatttgggttacttgttcgttaacttacggtaacttcggacgttaccgtaacggttccgtaaccccggg

SEQ ID NO: 342426 - DNA, 590 bp, Homo sapiens
  misc_feature: GZ8MTXP01ETAY1.51.14.B03.1.454.CMB.2.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
  modified_base (414)..(414): a, c, t, g, unknown or other
  misc_feature (414)..(414): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggccctcctatgagctgacacagccaccctcggtntcagtgtccccaggacagacggccaggatcacctgctctgganatgcatgaccaaaccgatatgtcttagttgtaccagcagaacgccggcacggcccctgtgtgtgatgtaataaagacactgagacggccctcgaacgggactcccgtgacgcgtacttcgtcgtcggctccgaggtcgagggaccaacggtcaacgngttggcccagtcgagtggacgtccgggaggccgaagggacgggacggaggtccgtaggtaaccttaagttagtttacggactaaataacaaacgacgaccttaaacctaagtttcgttaactttgacgtttcgtacgggtaactggtaccgaaccgtaacggttcccgtaacccgg

SEQ ID NO: 342427 - DNA, 627 bp, Homo sapiens
  misc_feature: GZ8MTXP01AD4J8.51.14.B03.1.454.CMB.2.raw
  modified_base (316)..(316): a, c, t, g, unknown or other
  misc_feature (316)..(316): n is a, c, g, or t
tcagcgatcgtatacacgaccggtgctcgatttagtgtgagtagttcgcgggcacgaccggtgctcgatttagtagtgtagattcggcgggggtgggtccaggaggcagaactctgggtgtctcaccatggcctggatccctctacttcctccccctctcactctctgcacaggctctgaggcctctatgagctgacacagcccaccctggtgtcagtcgtcccaggacagacggccaggactcacctgctgtggagatgcatgaccaaacgatatgcttatgtacagcagagccggcacggcccctgtgttggtnatgtaataaagacacgtgaggacggccctagaacgggactcccgtgacgcgtacttcgtcgtcgctaccgaggtcgaagggtaccgaacggttcaacgtagttcgggacctacttacgacggttgggacgtacccggggaggacgagggaacgggaccggaaggtccgtaggtaaccttatttacgttacggtactaaattaaccaaagaacgaaacccttacttaacggtttacggttaccttagttacgttaacggtttacggaaccgttcggacccggttaaccgtaacgggttcccgtaaccccggg

SEQ ID NO: 342428 - DNA, 497 bp, Homo sapiens
  misc_feature: GZ8MTXP01DRYP2.51.14.B03.1.454.CMB.2.raw
  modified_base (363)..(363): a, c, t, g, unknown or other
  misc_feature (363)..(363): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggctaggatcacctgctctggagatgcatgcaaaccgatatgcttatggtaccagcagaagccggcaggcccctgtgttggtgatgtataaagacacctgagaggccctcaagggatccctgagcgatcnctgggctcaggtcagggacaacggtcaacattggccatcagtgagtccgaaggcagagcgagctgactattatgtcaatcaangacaccattgttacttnttgtctacggaactgcgaccaaggttctaacccg

SEQ ID NO: 342429 - DNA, 652 bp, Homo sapiens
  misc_feature: GZ8MTXP01DU2X6.51.14.B03.1.454.CMB.2.raw
  modified_base (217)..(217): a, c, t, g, unknown or other
  misc_feature (217)..(217): n is a, c, g, or t
tcagcgatcgtatacacgaccggtgctcgatttagtgtgagtagttcgcgggcacgaccggtgctcgatttagtagtgtagattcggcgggggtgggtccaggaggcagaactctgggtgtctcaccatggcctggatccctctacttcctccccctcctcactctctgcacaggctctgaggcctcctatgagctgacacacgcccacccgtggtntcagtcgtcccaggacagacgccaggatccactgctcgtggagatgacatcgaccaaacgatatgtactttagttggtaacccagacaaggaacggcccgggaccacggtccccgttggttggtttggtagattagtaaactaaagacctaccgtaggaacggaccggtccctacggaaagggacctcccgtaggacgtccgttattcctcgcggtcctaccgaggtcgaacgggacgaaccggttcaacgtagttcggaccctagttccgaggtacggacgtaccgggagggacgaaggaggaccggtgcgtagtacttagtattacgtaacctaaataacaaacgacgtaaccttacgttacgtttacgttacgtttgttacgttaacgttacggaacgtcgaccggttaaccgtaaccggttccgtaaccgg

SEQ ID NO: 342430 - DNA, 723 bp, Homo sapiens
  misc_feature: GZ8MTXP01DW9YL.51.14.B03.1.454.CMB.2.raw
  modified_base (120)..(120): a, c, t, g, unknown or other
  misc_feature (120)..(120): n is a, c, g, or t
  modified_base (214)..(214): a, c, t, g, unknown or other
  misc_feature (214)..(214): n is a, c, g, or t
tcagcgatcgtatacacgaccggtgctcgatttagtgtgagtagttcgcgggcacgaccggtgctcgatttagtagtgtagattcggcgggggtgggtccaggaggcagaactctgggtntctcaccatggcctggatccctctacttcctccccctctcactctctgcacaggctctgaggcctctatgagctgacacacgcccaccctggtntcagtcgcccaggacagacgcagatcactgctcgtggagatgcatcgaccaaacgatactgtacttagtgtaaccagacaggaacgcccgggaccgacggtccccgttggtggtttggtagtattagtaaataaaggacaccgtaggaagaccggaccctacgaaacgggtacctcccgtaggacgtcgtacgtttcctcggtcgtccgttaccgaacgggttacggaacgggggaacctaaccgggttacaaaccgtaggtttaccggaccctaagttaccgaagggttaggacgtacccgggagggacgaagggtaacgggaaggacgggtaccttaaggtaaacgtttaattagttaacgtaaccctaaaactaaaccgtaaaccgaaaccgtaaaccttaaaccgttaagtttaccgtttaaacgtttacgttaccgttaaccgttaacggtaaccgtaccggaaccggttaaaccccggtaaccggttaaccccgtaaccccgg

SEQ ID NO: 342431 - DNA, 632 bp, Homo sapiens
  misc_feature: GZ8MTXP01DUCDH.51.14.B03.1.454.CMB.2.raw
  modified_base (216)..(216): a, c, t, g, unknown or other
  misc_feature (216)..(216): n is a, c, g, or t
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgaccacacgcccaccctcggtntcagtcgtccccaggacagacggccaggatcactgctctggagatgctatcgaccaaacgatatgcttagttggtaccagcagaacgcccgggacacggcccctggtgttggtnatagtaataaagacactggagaccgcctacgaagggactcccgngacgcgtattcctcgtcggtcctaccgaggtcgaacggggacctaacgggtacaacgtagtttcggacctaagtacgaggtcggaacggtaccggagggacgaaggaacggggaccggaggtccgtagtaaaccgttatttagttagtactaaataaccgaacacgacttaaaccgttagtttcgggttaactttgttacggtttccgttacggtaacgttcggaccgttaaccgtaacggttcccgttaaccccggg

SEQ ID NO: 342432 - DNA, 685 bp, Homo sapiens
  misc_feature: GZ8MTXP01DNDL7.51.14.B03.1.454.CMB.2.raw
  modified_base (258)..(258): a, c, t, g, unknown or other
  misc_feature (258)..(258): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacgccaggatcacctgctctgganatgcatcgaccaaaccgatatgtcttagttggtaccagcaagaacgccgggccacggcccctgtgttggtgatagtaataaagacacgtgagacggccctagaagggactcccgtgacgcgtattccgtcgtggcctaccgaggtcgaacgggacaacggtcaacgtagttacggacctagtccgaagggtcgggtaaccgtaccggggaacgggaccggaaagggaacggggaacccggaagggtacccgtagggtaacctttaaacgttttagttacggtaaacctaaacgttaaccaaaacaacggtaaaccttaaacccgttaagtttacgggtttaaactttacgttacggtttaaccggtttaaccggtaacgttacgggacccgttaaaccggtaaccgggttccccgttaaccccgggg

SEQ ID NO: 342433 - DNA, 730 bp, Homo sapiens
  misc_feature: GZ8MTXP01BPY48.51.14.B03.1.454.CMB.2.raw
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
tcagcgatcgtatacacgaccggtgctcgatttagtgtgagtagttcgcgggcacgaccggtgctcgatttagtagtgtagattcggcgggggtgggtccaggaggcagaactctgggtgtctcaccatggcctggatccctctacttcctccccctcctcactctctgcacaggctctgaggccctcctatgagctgacacacgcccacccgtggtntcagtcgtccccgaggacagacggccaggatccactgctacgtgganatgctagtcgaccaaacgtatatcgtacttagttcggaccagacgaagaacggcccggaccacggtccccttaggtgtttaggtagtagttagtaaagtaaacgactaaccgtaggacggaccggtcccgtacggaaacggggtaccctccggtagacgggtaccgtactttccgtacggtcgggtacccttaccggggaaggtaccggaaacggggtaaccgtaaccgggttactaaaccggttacggttccggacccgtaagttaccggagggttaacgggtaccggaaccgggggaacggaacgggaacgggaacggggaaccggtacggtaccgttagttaaaccttagttaccgtttagactaaacaacaaagactacttaaccgtagttaccggttaatttcgttagttccgtaacggaacgttcgaaccggttaccgtaacggttcccgtaacccggg

SEQ ID NO: 342434 - DNA, 642 bp, Homo sapiens
  misc_feature: GZ8MTXP01AJZXD.51.14.B03.1.454.CMB.2.raw
  modified_base (316)..(316): a, c, t, g, unknown or other
  misc_feature (316)..(316): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcatgaccaaaccgatatgcttatgtaccagcagagccggcaggcccctgtgttggngatgtaataaagacacctgagacggccctcgaacggggactcccgtggacgtcgtactttcctcgtcgggcctccgacgggttcgaacggggaccgtaaccgggtacacgtaacgtttcgggaccctaagttccgaggttacgggacgttccggaagggaccgaaggaacgggaacggacgggtacctagggtaaaccttatttacgtttacgtacctaaataacaaacgttaaaggacccaaccgttaggtttacggttacctttagttcgttaaccgttacggtaacgttcggaccgaccgtaacggttcccgttaaccccggg

SEQ ID NO: 342435 - DNA, 641 bp, Homo sapiens
  misc_feature: GZ8MTXP01A3VLL.51.14.B03.1.454.CMB.2.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctctatgagctgacacacgccaccctggtntcagtcgccccagacagacgccaggatcacctgctntggagatgcatcgacaaaccgataatgtcttagttcggtaccaagcagaacggcccgggaccacggcccctggtgtttggtgatagtaataaagacactggagacgccctcgaaaggactcccgtagacgcgtacttcgtcgtggacctcgtagtacggaacgggaaccgaacggtcaacgttaacgttccggacacgttacgaaggttgggaacgttccggaagggaccgaaggaacgggacgaccggtataggtaaccttagttaagttgtaacctaaactaacaaacgacggtaaaccttaccgttaacgttaggtttaaccttgttaccgttaacggttaccgtaacgttccggacccggttaaacgtaacgttcccgttaaccccggg

SEQ ID NO: 342436 - DNA, 551 bp, Homo sapiens
  misc_feature: GZ8MTXP01E0ULJ.51.14.B03.1.454.CMB.2.raw
  modified_base (455)..(455): a, c, t, g, unknown or other
  misc_feature (455)..(455): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagcccaccctcggtgtcagtgtcccccaggacagacggccaggatcacctgctctggagatgcatgaccaaaccgatatgcttattggtaccagcagaagcccgggccaggccccctgtgtttggtgattgtataaacgcacctgagacgcccctgaacgggactccctgagcgtacttctctgggcttaccgaggtcaggggacaacgggtcacagttcggccatcagtggagtccggagcaggaggacgaggntgacttattattgcaatcgaaacttagaccaccgtagtttaggactttagttcgttcgttacggaactcgcgaacctaaggttcccgtaacccggg

SEQ ID NO: 342437 - DNA, 808 bp, Homo sapiens
  misc_feature: GZ8MTXP01BVUVK.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttcctcccctctcactctctgcacaggctctgaggcctctatgagctgacacacgccaccgtcggtgtcagtcgtcccaggacagacgccaggactcactgctcgtggacgatgctatacggacccaaaaccgtatatcgtactttagttacggtaaccgagaccgaaggaaccggcccgggaccgaccggtcccccgttggttacggtttgggtacgtacgttaagttaaacgtaaacggactaacccggtaggtaacggtaccggtaccccgttacgggtaaaacgggtacccgttcccccgttagggaaccggtacggttaaccgtttccgttacgggtcgggtacccgttacccgggtaacggggttacccggaacgggggtaaacccgtaaccggggttacctaaacggttacgtttacgggaccctagttaccgtaggtacgggtaccgttacggggacgggacgaacggacgggacggacggtcgttaagtaaccgtttagttacgttacgtaaccttaacgtaaccaaacggttaacgaacccttaaaccgttaaggtttaacgttaacgtttacgttacggtttaaccgttaaacgggtaaccgttaaccgggaccgttaaaccggttaaccgggttcccgttaaccccggggg

SEQ ID NO: 342438 - DNA, 830 bp, Homo sapiens
  misc_feature: GZ8MTXP01BGZNR.51.14.B03.1.454.CMB.2.raw
  modified_base (267)..(267): a, c, t, g, unknown or other
  misc_feature (267)..(267): n is a, c, g, or t
  modified_base (726)..(726): a, c, t, g, unknown or other
  misc_feature (726)..(726): n is a, c, g, or t
tcagcgatcgtatacacgaccggtgctcgatttagtgtgagtagttcgcgggcacgaccggtgctcgatttagtagtgtagattcggcgggggtgggtccaggaggcagaactctgggtgtctcaccatggcctggatccctctacttcctccccctcctcactctctgcacaggctctgaggccctcctatgagctgacacacgcccacccgtcggtcgtcagtcgtccccaggacagacggccaggactccactgctcgtggagntgctatcgaaccaaaccgatagtgtactttagttacggtaccagacgaacggaacggtcccggggaccccgtacgggtcccccttggttacggtttgggtagtaagtttaggtaaataaaacgaccgtaaccgtacggacggtaccggtccccttacggaaacggggtacccttcccgtaggtacgtaccgtactttccgtccgttcgggtacccgttacccgagggttacccggaaacggggtaacccgtaaacccggggttacctaaccggttaacgttccgggtacccggtaaacttccgggtaaagggttaacggggtaacccggttaccggggaaacggggtaacggaaacggggaaccggggaaaccgggtaaccgggtacgttaacggttaaaccttaaggtttaacgtttcggtaaacttaaaccaaaccgtaaacggttaccgtaaaccncgttaaaacggtttcgtttaaaccgtttgtttaccgggttccgtttaacgggtaaccgtcgggtacccgaaacccggttaaacggttccccgtaacccccgggg

SEQ ID NO: 342439 - DNA, 888 bp, Homo sapiens
  misc_feature: GZ8MTXP01BNRZW.51.14.B03.1.454.CMB.2.raw
  modified_base (212)..(212): a, c, t, g, unknown or other
  misc_feature (212)..(212): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacacgccaccctggtntcagtcgtccccaggacagacgccaggatcacctgctctggagatgcatgaccaaacgtactaatcgtactttagttacggtaccgagaccgaacggaaacggccccggggaccgaacggtccccccgtttggtttcgggtttagggttacggtaaagtttaggttaaaacgttaaaaacggaccgtaaacccggttacggaacgggaacccggggtacccccgtttacgggaaaacgggggttaaccctttccccggttacgggtaaccgggtaccgggtttaaccttttacccgttaccggttcggggtacccctttaccccggggaaggggtttaacccggaaacgggggtaacccgtaaacccggggttacctaacggtaacggtttcgggaacccctaagttaccggtaagggtttacggggaccggttacggggtaaacggggacgtaaacggggtaacggggtaccgggaacgggttaccgttaagggttaaacccgttaactttttaaggggtttacccgtaagttaaaccttaacgtaaaaccggacgtaaaccttacccgttaaacgttttaagggttacccttttaaaggttccgtttaaccggttacgggtaaccgttcggtacccgttaaacccggtaaccgggtttcccgtaacccccgggg

SEQ ID NO: 342440 - DNA, 634 bp, Homo sapiens
  misc_feature: GZ8MTXP01AU2AD.51.14.B03.1.454.CMB.2.raw
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagcgatcgtatacacgaccggtgctcgatttagtgtgagtagttccgcgggacgaccggtgctcgatttagtgtgagtagttccgcgggcacgaccggtgctcgatttagtgacatctcgcagttcgtttgggggctgtgggtccaggaggcagaactcgtgggtgtctcaccatggcctggactccctctaccttcctccccctcctcactctctgcacaggctctgacgcctctatgtgctgacacacgccctacccgtcggtcgtccgtcgccccaggacagacgcagctcacctgctcgngganagtcnctacttcgacccaaccctacttacttcttagttacggaaaccaacgaacgaacgccgacggacccgacggtccccgttagttcgtttaggttagtaaattaataaagtaaagacgtagtagacgacggtccgtacgaacgggtacttcccgtagtacgtacgttacttccgtcgtcggtcctaccgaccgtacgacgggacctacgtcgtaccactacgttcgaacctagtcgtacggtaaggtacgttacggaacggacgaacggaacggacgaggttcgtaatacgttaattacctgttaacctaacttcgttaacg

SEQ ID NO: 342441 - DNA, 489 bp, Homo sapiens
  misc_feature: GZ8MTXP02IDHO3.51.14.B03.1.454.CMB.2.raw
  modified_base (389)..(389): a, c, t, g, unknown or other
  misc_feature (389)..(389): n is a, c, g, or t
tcagcgatcgtatacacgaccggtgctcgatttagtgtgagtagttcgcggcacgaccggtgctcgatttagtagtgtagattcgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacacctgagaggccctcgagggatccctgagcgattctctgctccagtcagggacaacggtnacatggcatcagtgagtcaggcagagacgaggctgactattatgtcaatcaaacagacacattggacttatgtcttcggaactgacgacaaggtcacccg

SEQ ID NO: 342442 - DNA, 493 bp, Homo sapiens
  misc_feature: GZ8MTXP02G24Z6.51.14.B03.1.454.CMB.2.raw
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
  modified_base (463)..(463): a, c, t, g, unknown or other
  misc_feature (463)..(463): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaaganacctgagagccctnagggatccctgagcgattcnctggctccaggtcagggacaacggtnacattggccatcagtgagtcaggcagagacgaggcngactatatgtacaatcaacagacaccatgtactatntcttcggaaactcgcgaccaaggtcacccg

SEQ ID NO: 342443 - DNA, 507 bp, Homo sapiens
  misc_feature: GZ8MTXP02GN1KB.51.14.B03.1.454.CMB.2.raw
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtaataaagacactgagaggccctcagggatcccgtgagcgattctctggctccaggtccaggggacaacgggtcacattggccatcagtggatccaaggcagaggacgaggcngactatatgtcaatcaacaanacactagttacgtacttatgtcgttacgaactcgacgaacgacgtactacg

SEQ ID NO: 342444 - DNA, 517 bp, Homo sapiens
  misc_feature: GZ8MTXP02F9D0Q.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacacctgagaggccctcgagggatccctgagcgattctctggctccaggtcagggacaacggtcacattcggccatcagtggagtccgaggcaggagggacgaggctgactagttatgtacaatcaaacagacaccattcgtacttatgtcgttacggaactcggaccgaacaacggtctaacccgg

SEQ ID NO: 342445 - DNA, 515 bp, Homo sapiens
  misc_feature: GZ8MTXP02FVJE5.51.14.B03.1.454.CMB.2.raw
  modified_base (318)..(318): a, c, t, g, unknown or other
  misc_feature (318)..(318): n is a, c, g, or t
  modified_base (439)..(439): a, c, t, g, unknown or other
  misc_feature (439)..(439): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaaccgatatgcttatggtaccagcagaagccggccaggcccctgtgttggngatgtataaagacactaagaggccctcgagggactccctgagcgtattcctctggctccgaggtcaaggggacaaacgggtcactattcggccatcagtgagtccgaggcagagacgagcngactattatgacaatcaaacagacacctagttacgtacttagtcgtcttcggaactcgacacgacgtcaccgtccg

SEQ ID NO: 342446 - DNA, 502 bp, Homo sapiens
  misc_feature: GZ8MTXP02FJHYM.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacacctgagaggccctcgagggactccctgagcgattctctggctccaggtcagggacaacggtcacattgccatcagtggagtccaggcaggaggacgagctgactagttattgtacaatcaaacagacaccattcggtactatgtcttcggaactgcacaacggtctaccg

SEQ ID NO: 342447 - DNA, 589 bp, Homo sapiens
  misc_feature: GZ8MTXP02GFKE1.51.14.B03.1.454.CMB.2.raw
  modified_base (256)..(256): a, c, t, g, unknown or other
  misc_feature (256)..(256): n is a, c, g, or t
  modified_base (318)..(318): a, c, t, g, unknown or other
  misc_feature (318)..(318): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttatggtaccagcagagccggccaggcccctgtgttggngatgtataaagcaccgtgagacggccctgagggactcccgtgagcgtattctcgtgggcctcgaggtcagggacaacgggtcacgagttcggacctagtccgaggttgggacgtccgagggcgagggagggacggaggctacggtaacttaagtttagttacgtactaaaattaccaaaacgacgaacctaacctagtttacggttaactttagttcgttaacgtttacggaaacttcggaccgaacccgtaaacgggtccctaacccggg

SEQ ID NO: 342448 - DNA, 511 bp, Homo sapiens
  misc_feature: GZ8MTXP02F32N3.51.14.B03.1.454.CMB.2.raw
  modified_base (366)..(366): a, c, t, g, unknown or other
  misc_feature (366)..(366): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacacctgagaggccctgagggatccctgagcgattcnctggctccaggtcagggacacggtcacattggccatcagtggagtccaggcagaggacgaggctgactattatgcaatcaacagacaccaattcggtaacttagtgtcgttacggaacttcgaccgtacaacggtcctaacccgg

SEQ ID NO: 342449 - DNA, 518 bp, Homo sapiens
  misc_feature: GZ8MTXP02GEQF9.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcatgccaaaccgatatgcttattggtaccagcagaagccgggccaggcccctgtgttggtgatgtataaagacacctgagagccctcaggactcccgtgagcgattctctggctccaggtcagggaacaacggtcacattcggccatcagtggacgtccgaggcaggaggacgagctagactattatgtacaatacaacagacaacctattacgtacttatgtcttacggaactcgacgaaccgacggtctaacccgg

SEQ ID NO: 342450 - DNA, 639 bp, Homo sapiens
  misc_feature: GZ8MTXP02I4SQP.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatgtaccagcagaagccggccaggcccctgtgttggtgatgtataaagacacctgagacggccctcgagggactcccgtagacggcgtattctcgtcggcctccgaggtcgacggggacaacgggtcaacgtaagttcgggaccctaattccgaaggttacgggacgtacccgaagggccgaagggacggggaacggagggaccgtaggtaacttaagtttagtttcggtactaaaacgttacaaaacgaacggtaaccaacccgtaaagtttacgggttaaacctttagttacgtttaaccgttaccgggtaaaacgttcggaccgtaaacccggtaaacggttacctaacccccggg

SEQ ID NO: 342451 - DNA, 680 bp, Homo sapiens
  misc_feature: GZ8MTXP02F6KH7.51.14.B03.1.454.CMB.2.raw
  modified_base (212)..(212): a, c, t, g, unknown or other
  misc_feature (212)..(212): n is a, c, g, or t
  modified_base (319)..(319): a, c, t, g, unknown or other
  misc_feature (319)..(319): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtntcagtcgtccccaggacagacggccaggatcacctgctctggagatgcattgccaaaccgatatgcttatggtaccagcagaacgccggccaggcccctgtgttggngatgtataaagacactgagacggccctcgagggactcccgtagacgacggtattccgtcgtacgggcctacccgaggttccgaagggggaactaaccggggtacaacgtaacgtttcgggaccctaagttaccgaggtttacggggaacgttcccggaaaggggccgtaaaggggaaggggaacgggtaacgggccgttaaggtaaccgtttaatttaaagttcggtaaactaaaacgttaaccgaaaaccaaacggtaaacccaaacccttaagtttacggttaaacctttaagttcgttaacgtttaccgggaaacttacggacccgtaaaaccgtaacgggtacccttaaaccccggg

SEQ ID NO: 342452 - DNA, 506 bp, Homo sapiens
  misc_feature: GZ8MTXP02H58OL.51.14.B03.1.454.CMB.2.raw
  modified_base (346)..(346): a, c, t, g, unknown or other
  misc_feature (346)..(346): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagagccggccaggcccctgtgttggtgatgtataaagacacctgagaggccctnagggatccctgagcgattctctgctcccaggtcagggacaacggtcacattggcatcagtgagtccaggcagaggacgagctgactattatgtacaatcaaacagacaccattacgtacttaatgtcgttcggaaactcgacgaccaaggttcaacccgg

SEQ ID NO: 342453 - DNA, 540 bp, Homo sapiens
  misc_feature: GZ8MTXP02GZGHB.51.14.B03.1.454.CMB.2.raw
  modified_base (321)..(321): a, c, t, g, unknown or other
  misc_feature (321)..(321): n is a, c, g, or t
  modified_base (494)..(494): a, c, t, g, unknown or other
  misc_feature (494)..(494): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgatatgacttatggtaccagcagaagccggcagcccctgtgttggtnatgtataaagacactgagacggccctgagggactcccgtgacgacgtattctcgtggctcgaggtcagggaacacggtcactagttgaccatcagtggacgtccgaaggcaggacgggacgaggctagaacttattagtagtacaatacaacagacactacgttgtaaacttntacgttcgttacggaacttcgaccgtaacgtacggtactaacccgg

SEQ ID NO: 342454 - DNA, 508 bp, Homo sapiens
  misc_feature: GZ8MTXP02F58YO.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacacctgagagccctgagggactcccgtgagcgtattctctggctccgagtcgagggacaacggtcacattggccatcagtggagtccgaggcagaggacgagctagactagttatgtacaatacaacagacactattacgtacttatgtcgttcgactcgacgacgacgtctaccg

SEQ ID NO: 342455 - DNA, 545 bp, Homo sapiens
  misc_feature: GZ8MTXP02HX8I3.51.14.B03.1.454.CMB.2.raw
  modified_base (319)..(319): a, c, t, g, unknown or other
  misc_feature (319)..(319): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggcaggcccctgtgttggtnatgtaataaagacactgagacgcctagagggactcccgtgacgcgtattctctggcctccgaggtcagggacaacggtcacagttcggcctatcgagtaggacgtccgaggcgaggacgggacgaggctagactattattgtactaatcaaacagaaccacctaagttacggtacttaatcgtaacgtttacggaacttcggaccgtaccgaacggttacacccgg

SEQ ID NO: 342456 - DNA, 535 bp, Homo sapiens
  misc_feature: GZ8MTXP02FO1DB.51.14.B03.1.454.CMB.2.raw
  modified_base (273)..(273): a, c, t, g, unknown or other
  misc_feature (273)..(273): n is a, c, g, or t
  modified_base (346)..(346): a, c, t, g, unknown or other
  misc_feature (346)..(346): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacacctgagagccctnagggatcccgtgagcgattctctggcctcgaggtcagggacaacggtcacgattggcccatcgagtaggagtccagggcaggaggagaaggctggactattatgtacaaatcaaacagacaacctagttacgttaacttattcggttcttacggaaacgttcgaccgaacgtaaacggtcctaacccgg

SEQ ID NO: 342457 - DNA, 584 bp, Homo sapiens
  misc_feature: GZ8MTXP02F1T9T.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtaataaagacacctgagaggccctcgagggactcccgtgacgcgtattctcgtggcctccgaggtcgagggaaccaacggtcacagttcggaccatcagtggacgtccgaggcagagggacgaggctaggacttattattgtacaaatacaaacaacgaaccaacctaagtttacgggttaaactttacgttacgttaaccgtttaccggtaaaacgttcggaacccgtaacccgtaaacgggttaccctaacccccggg

SEQ ID NO: 342458 - DNA, 505 bp, Homo sapiens
  misc_feature: GZ8MTXP02I1FGE.51.14.B03.1.454.CMB.2.raw
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggcccctgtgttggtnatgtataaagacactgagaggccctnagggactcccgtgagcgtattctctgggctccaggtcaggacaacggtnacattggccatcagtgagtccgaggcaggaggacgaggctagactattattgacaatcaaacagacacattcgtactatagtcgtcgaactgaccgacgtacgtctaccg

SEQ ID NO: 342459 - DNA, 511 bp, Homo sapiens
  misc_feature: GZ8MTXP02F365X.51.14.B03.1.454.CMB.2.raw
  modified_base (456)..(456): a, c, t, g, unknown or other
  misc_feature (456)..(456): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacacctagagaggccctgagggatccctgagcgattctctggctccagtcagggacaacggtcacattgccatcagtgagtccaggcagagggacgaggctagtactagttatagtacaatcaaanagacacctattcgtacttatcgtcgttcggaaactgacgaccaaggtcctaccgg

SEQ ID NO: 342460 - DNA, 552 bp, Homo sapiens
  misc_feature: GZ8MTXP02IGRRM.51.14.B03.1.454.CMB.2.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacagcccaccctcggtntcagtcgtccccaggacagacggccagatcactgctntgagatgcattgaccaaacgatatgcttatgtaccagcaagaagccggccaggcccctgtgttggngatgtaataaaagacactagagacggccctagagggacttcccngagcgattctcgtgcctccaggcaaggggacaacggtcaanagttcgccaanacgagtagagacgagagagaggagagagtagtattaattattagtactaaactaacaaacaaacaactaacctaacgttacgttaacttaattacgttaacgttacgtaacgtacgaccgtaaccgtaacgtacgtaccg

SEQ ID NO: 342461 - DNA, 731 bp, Homo sapiens
  misc_feature: GZ8MTXP02HUGMK.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaacgccgggccacggcccctgtgttggtgatagtataaagacacctgagacggccctgagggactcccgtgacgcgtattctcgtcgggtcctccgtagggtaccgacggggaacgtaaccgggtaccaacgtaacgtttcgggacccctaaagtccgtaagggttacgggacgttacccggaaggggacccggaaaggggaaacggggaacccgggaaggggtacccgttaaggggtaaacccttttaagtttaaggttttacggtaaccgttaaaacgttaacctaaaacccgaaacggtaaaccctaaacccgttaaagttttacggggtttaaacccttttaaaagtttccgtttaacccggtttaacggtaaaccgttacggaacccggtaaacccgttaaaacggggttcccgttaaacccccgggg

SEQ ID NO: 342462 - DNA, 562 bp, Homo sapiens
  misc_feature: GZ8MTXP02I6UGV.51.14.B03.1.454.CMB.2.raw
  modified_base (349)..(349): a, c, t, g, unknown or other
  misc_feature (349)..(349): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaacgccgggccaggcccctgtgttggtgatgtataaagcacctgagacgcctnagggactcccgtgagcgtattctcgtcggcctccgaggtcgaacggggaacaacgggtcacagttcggcctatcaggttggacgtccaggcagaggacgaggctagacttatagttgtacaaagtacaacaacgacaaacctagtttacggtaaccttagtacgttcgttaacggaaacttcggaccgtaaccgtaaacggtcctaaccccgg

SEQ ID NO: 342463 - DNA, 513 bp, Homo sapiens
  misc_feature: GZ8MTXP02FI1P5.51.14.B03.1.454.CMB.2.raw
  modified_base (276)..(276): a, c, t, g, unknown or other
  misc_feature (276)..(276): n is a, c, g, or t
  modified_base (321)..(321): a, c, t, g, unknown or other
  misc_feature (321)..(321): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaaccgntatgcttatggtaccagcagaagccggccaggcccctgtgttggngatgtataaagacactgagaggccctcagggatccctgagcgattctctcgggctccgaggtcagggacacggtcacattggcatcagtggagtccaggcagaggacgagctagactattatgtacaatcaaacagacacattacggtacttagtgtcgttacggaactggactaccgaacgtctaacccgg

SEQ ID NO: 342464 - DNA, 557 bp, Homo sapiens
  misc_feature: GZ8MTXP02F5NGJ.51.14.B03.1.454.CMB.2.raw
  modified_base (256)..(256): a, c, t, g, unknown or other
  misc_feature (256)..(256): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgatatgcttatggtaccagcagaagccggccaggcccctgtgtggtgatgtataaagacacctgagaggccctgacggactcccgtgagcgtattctcgtgcctcgagtcgaggacaacggtcacgattcggccatcaggtggacgtaccgaggcgaggacggacgaggcgtagactattatgtactaactcgaaacacgacctaaccgtatttacggtaacttagttacgttccgtttacggaaccttacggaccgtaaccgtaaacgggtcccttaaccccggg

SEQ ID NO: 342465 - DNA, 676 bp, Homo sapiens
  misc_feature: GZ8MTXP02JPF0S.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattgaccaaaccgatatgcttatggtaccagcagaacggccggccacggcccctggtgttggtgatgtaataaagacaccgtgagacgccctcgagggactcccgtgacgcgtattcctcgtcggcctaccgaggtccgaacggggaacaaaccgggttcaacgtacgttacgggacccagttaccgaggttagggacgttacccgagggaccgaaggaacgggaaccggaaggccgtaaggtaaccttaatttaagttacggtaactaaaacttaccgaaaacgaaacggaaaccctaaacccgttaagttttacgggttaaaccttttaagttacgttaaccgtttaccgggtaaaaccgttcggtaacccggaaacccggtaaaaccgggttcccgttaaacccccgggg

SEQ ID NO: 342466 - DNA, 537 bp, Homo sapiens
  misc_feature: GZ8MTXP02JM0XQ.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattcggtaccagcagaagccgggccaggcccctgtgttggtgatgtaataaagacactgagacgccctgagggactcccgtgagcgtattctcgtggctccgaggtcgagggacacggtcacattcggcatcagtggagtcgaggcaggaggacgaggctgactattattgtacaatacaaacgagacacctagtttacggtactttagtcgttaacgttacggaactcggacgaccgaaacggtcctaaccccgg

SEQ ID NO: 342467 - DNA, 605 bp, Homo sapiens
  misc_feature: GZ8MTXP02GECI2.51.14.B03.1.454.CMB.2.raw
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagcccaccctcggtntcagtcgtccccaggacagacgccaggatcacctgctcgtgganatgcatcgaccaaaccgatatgtcttatcggtaccagcgagaacggccgggccacggccccgttggtcggttggtgatagtaataaagacactaggacgacggcctagacggtactccgtgacgcgtattctcgtcggcctacgacggtacgacggggaacctaacggtacaacgtacgttcggacctagtacgaggttgggacgtccgaggaccgaggacgggacgaggctagtacttagttatacgtactaacgtacaaacgtacgaactaacctagtttacgtaacttagttacgtaaccgttacggaacttcggaccgtaaccgtaccggtacgttaaccccgg

SEQ ID NO: 342468 - DNA, 503 bp, Homo sapiens
  misc_feature: GZ8MTXP02FS1E8.51.14.B03.1.454.CMB.2.raw
  modified_base (213)..(213): a, c, t, g, unknown or other
  misc_feature (213)..(213): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctggagatgcattgccaaaccgatatgcttatggtaccagcagagccggccaggcccctgtgttggtgatgtataaagacacctgagaggccctcgaggatccctgagcgattctctcgctccgaggtcgagggacgaacggtcacagttcggcctatacgaggtggagtccgaggcaggaggacgagctgactattatgtcaatcaacagacacattcgtactatgtcgtcgactcgacgacacgtctaccg

SEQ ID NO: 342469 - DNA, 619 bp, Homo sapiens
  misc_feature: GZ8MTXP02GGH1N.51.14.B03.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacacgccaccctcggtntcagtcgtccccaggacagacgccaggatcactgctgngganatgcattcgaccaaacgatatgtcttattacggaaccagacgaaggaacggcccgggaccacggccccttggttgttggagtatagtaaanaaagcaccgtgagacgccctagaggactcccgngacgtcgtacttcacgtcggacccttccgagggtaccaagggggaaccaaacgggttcaaacgtacgttcggacctaattccgagttacgggacgtccgaaggggcaaggagggacgtaacggtctagtaacttagtttactaggtaacaaagttacaaaacgacgaacctactaagtttacgtaacttagttcgtaacgtttaccgaacttcggactaaccgacggtaccctacccgg

SEQ ID NO: 342470 - DNA, 602 bp, Homo sapiens
  misc_feature: GZ8MTXP02GNTKV.51.14.B03.1.454.CMB.2.raw
  modified_base (212)..(212): a, c, t, g, unknown or other
  misc_feature (212)..(212): n is a, c, g, or t
  modified_base (271)..(271): a, c, t, g, unknown or other
  misc_feature (271)..(271): n is a, c, g, or t
  modified_base (315)..(315): a, c, t, g, unknown or other
  misc_feature (315)..(315): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctcggtntcagtgtccccaggacagacggccaggatcacctgctctggagatgcattgccaaacgntatgcttatgtaccagcagacgccggccacggccctgtgttggngatgtataaacgacacctgagacggccctacgagggactcccgtgaacgcgtattctcgtcggctcccaggtcgacgggtacaaacggtcacgattcggccagtacaggttaggacgttccgaaggcgaaggtacgggaacggaacggtctaggtaccgttaattagtttacgtacaaacgttaacaaaccgtaagaaccctaaaccgtagtttacggtaaccttttaagtcgtaacgtttacgggaacttacggaccgtaaaccgtacgggtccttaaaccccggg

SEQ ID NO: 342471 - DNA, 599 bp, Homo sapiens
  misc_feature: GZ8MTXP02I1I74.51.14.B03.1.454.CMB.2.raw
  modified_base (212)..(212): a, c, t, g, unknown or other
  misc_feature (212)..(212): n is a, c, g, or t
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacagccaccctcggtntcagtcgtccccaggacagacggccaggatcacctgctctggagatgcattgaccaaaccgatactgcttattcggtaccagnaagacgccgggccacggcccctaggtcgttggtagtacgtgtaataaagtaccacgtgacgacggccctcgacgggacttcccgngagcgtacttctcgtcgggctccgaggtccgaaggaacgtaacggtcactacgttcgaccatacgtaggtaggaccgtaccgacgggagacgggaacgggacgaagggtcctaggaaccttaattattagtacaaattacaaacaactacgaaacctgttacggtaaacttcgtattaaccgtacggtaactcgaccgtaccgaacggttacaacccgg

SEQ ID NO: 342472 - DNA, 574 bp, Homo sapiens
  misc_feature: GZ8MTXP02I676A.51.14.B03.1.454.CMB.2.raw
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacacctgagacgccctcgagggactcccgtgacgcgtattctcgtcgggcctccgaggtcagggacaacggtcactattggcctatcagtggacgtccgaggcaggaggacgaggctagacgtaattacttagtacaaactacaaaacaggaaccaaccgtaagtttacggttaacctttagttacggttccgttacgggtaaacttacggaccgtaaaccgtaacggttaccgtaaccccgg

SEQ ID NO: 342473 - DNA, 672 bp, Homo sapiens
  misc_feature: GZ8MTXP02IJ8KV.51.14.B03.1.454.CMB.2.raw
  modified_base (261)..(261): a, c, t, g, unknown or other
  misc_feature (261)..(261): n is a, c, g, or t
  modified_base (342)..(342): a, c, t, g, unknown or other
  misc_feature (342)..(342): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagccacctcggtgtcagtcgtaccccaggacaggacggccaggatcacctgctcgtggagntgcattcgaccaaacgatatgtacttagtcggtaccagcgaaggaacggcccgggaccacggccccttggtggtttggtanattagtaaataaaacgctaaccgtggaacgacggcccttacgagggttacctccgtgacggtacgtaccttcgttcgcggtaccctaccgaggtacgaacggggtaccaaacgggtcaacgtcgttacggaccctagttaccgagttaggacgtaccggaggcgaggacgggacgacggtctaggtacttaattacgttacgtaacaatacccaaaagacgtaacccgtaaacctcggttttaaacggtaacttttacgttaacgttaacggtttaccgaaaacgttcggaaacccgttaacgtaaaacccgggtccgttaaaccccggg

SEQ ID NO: 342474 - DNA, 637 bp, Homo sapiens
  misc_feature: GZ8MTXP02JV2SR.51.14.B03.1.454.CMB.2.raw
  modified_base (212)..(212): a, c, t, g, unknown or other
  misc_feature (212)..(212): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctctatgagctgacacagcccaccctcggtntcagtcgtccccaggacagacgccaggatcacctgctctggagatgactatcgaccaaacgatatgactttagttcggtaccagcgaagacggccgggccacggtccccttggttcggttggtacgagtagtaaataaacgactaccgtaggacggacggccccgtagacgggtactccgtgacgtcgtacttcctcgtcgccgtaccgtacggtaccggacggggaaccgtaaccggtaccgacgtacgtacggtaccgtacgtacgtacggtacgggtacgaccggacggaccgaggacgggacggacggtaccgtagtaacgttagtttattacggtactaactaacaacaacgactaactacgttacgtacttagtacgtcgttacgtacgtacgacgaacgtttttacgacgttacccgg

SEQ ID NO: 342475 - DNA, 657 bp, Homo sapiens
  misc_feature: GZ8MTXP02FP5E0.51.14.B03.1.454.CMB.2.raw
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (253)..(254): a, c, t, g, unknown or other
  misc_feature (253)..(254): n is a, c, g, or t
  modified_base (266)..(266): a, c, t, g, unknown or other
  misc_feature (266)..(266): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacacgccaccctggtntcagtcgtcccaggacacggcgacagcnccnctnctgaganngatatcacaacntatcgtcttagtcgacagcgagaccggccgcgacgtcccgttggtggtggagtatagaagtaaacacagtgacgccgtccgtaggacgtacttccggagacgtacgttacttccgtcggtccggtacctacggtaacggtacggaaacggaacggttacgtaccgtaacgtacgttaccggactacggtacgtaggggtacggtaaccggtacgggaacgacgggaacgggttaaacggggaaggtacccgtagttaacgtaacgtttaagttacgtacgtaactaacgtaaacaacgaccgttaaacacgtttacggttacgtttaactacgttacggttaaccgtacgtaacgacggtaccgtaaaccgtacgtaccggtttaacccgg

SEQ ID NO: 342476 - DNA, 604 bp, Homo sapiens
  misc_feature: GZ8MTXP02HUPM3.51.14.B03.1.454.CMB.2.raw
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (569)..(569): a, c, t, g, unknown or other
  misc_feature (569)..(569): n is a, c, g, or t
tcagcgatcgtatacacgaccggtgctcgatttagtgtgagtagttcgcgggcacgaccggtgctcgatttagtagtgtagattcgcgggggtgggtccaggaggcagaactctgggtgtctcaccatggcctggatccctctacttctccccctctcactctctgcacaggctctgaggcctctatgagctgacacacgcccaccctcggtgtcgagtcgtccccgaggacaggaccggcaggactcacctgctcgtggagatgcagttacgacccaaaccgtatactgtactttagtacgtaccagaccgaagaacggcccggaccgtaccggccccgttggtcggttggtgtaagtagtaataaagacaccgtagacgacgcccgtagacgggactccgtagacgacgtcttcgtcgtcgcttaccgagtacgacggtaaccgtacgggtactaacgtagttacggaccctaagtacgagggttacggacgacgacggagtagacgggacgaggactaggtattagttactgaacagtacacganaccncgttagtacgtacttancgtcgtactacgctaccgacgtaacgtctaaccgg

SEQ ID NO: 342477 - DNA, 651 bp, Homo sapiens
  misc_feature: GZ8MTXP02IW0DT.51.14.B03.1.454.CMB.2.raw
  modified_base (222)..(222): a, c, t, g, unknown or other
  misc_feature (222)..(222): n is a, c, g, or t
  modified_base (362)..(362): a, c, t, g, unknown or other
  misc_feature (362)..(362): n is a, c, g, or t
tcagcgatcgtatacacgaccggtgctcgatttagtgtgagtagttcgcgggcacgaccggtgctcgatttagtagtgtagattcggcgggggtgggtccagggaggcagaactctgggtgtctcaccatggcctggatccctctacttcctccccctcctcactctctgcacaggctctggacggccctcctatgagctagacacacgcccaccctgggtntccaggtccgtaccccgaaggacaacggaccggaccaggtactccacctggacctcgtggagatgactatcgaaccaacgatacgtgtacttagtacgaccagtcgaacgacggcccgggcacggtcccgtgttggttgntataagtaagtaaacgactaccgagaacgccgtcccgtacggacggtcctccggtgacgtaccgtattccgtcgtcggacctcccggaggtaccggaggaaccgtacggtcaacgtcgtcggacctagtcgaggtacggtacgaccgaggcgaaggggacggtagacgtctaagtacgttacttgtacgtacaataacgaccgaacgactaaccgttagttaacgttacgttcgttagtaacccgttaggaaccgtcgtacgaaacccggtcgtaacccggttacccgg

SEQ ID NO: 342478 - DNA, 509 bp, Homo sapiens
  misc_feature: GZ8MTXP01AEZWM.10.29.C07.1.454.CMB.2.raw
  modified_base (362)..(362): a, c, t, g, unknown or other
  misc_feature (362)..(362): n is a, c, g, or t
tcagcatagtagtgcacgaccggtgctcgatttagagtgctacgaagggaaagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccaaactcatgatttttgatgtcagtaatcggccctcagggggtttctaatcgcttctctcggctcaagtctggcaacncggcctccctgaccatctctgggctcaggctgaggacgaggctgattatactgcagctcatatacaaccagcagcacttctgtattcgggcgagggaccaagcgtgaccgttcaggttcaagcccaaggctcgcccctcggctaacc

SEQ ID NO: 342479 - DNA, 529 bp, Homo sapiens
  misc_feature: GZ8MTXP01DVAPK.10.29.C07.1.454.CMB.2.raw
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggcaaacgccccaaactcatgattttgatgtcagtaatcggccctgtagggtttcaatcgtcttctctcggctcagtctggacaacncggcctccctagaccatctcgtcgggctcgaggctgagacgaggctgattatactgacngctcatactacaacgancagcacttctgtacgttcgggcggtacggaccaaagcgtcgtaccgttccgttggttcaacgcccaaggcctccgccccgtcggcctaacccg

SEQ ID NO: 342480 - DNA, 515 bp, Homo sapiens
  misc_feature: GZ8MTXP01E225N.10.29.C07.1.454.CMB.2.raw
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
tcagcatagtagtgcacgaccggtgctcgatttagagtgctacgaagggaaggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcncctgcactggaaccagcagtgacgttggtgttataactntgtctctggtaccaacaacaccaggcaaagccccaaatcatgatttttgatgtcagtaatcggcctcagggggtttctaatcgacttctctggctcaagtctggcaacncggcctcctgaccatcnctgggctcaggctgagcgaggctgattatactgcagctcatanacaaccagcagcactctgtattcggcggagggacgaacgacgtcgacgttccgttcggttcgaacgaccgaacggctcgcccctccggttcgtaacccg

SEQ ID NO: 342481 - DNA, 534 bp, Homo sapiens
  misc_feature: GZ8MTXP01DLRHT.10.29.C07.1.454.CMB.2.raw
  modified_base (245)..(245): a, c, t, g, unknown or other
  misc_feature (245)..(245): n is a, c, g, or t
  modified_base (356)..(356): a, c, t, g, unknown or other
  misc_feature (356)..(356): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactatgtctctgtaccaacaacaccagcaaacgccccaaactcatgattttgatgtcagtaatcggcctctagggtttctatcgcttctctcgctcaagtctggacaacncgcctccctgaccatctctcggcctcagcctgaggatgaggctgtattattacttgttcgctctatatgcgaggtcgtaccgtgttgggtggtcgggcggacgggaacgaagcgtcggaccgtcgtacggttcgcgacccaagggcctccgccccgtcggcctaaccgttcgttcccg

SEQ ID NO: 342482 - DNA, 520 bp, Homo sapiens
  misc_feature: GZ8MTXP01CIO7D.10.29.C07.1.454.CMB.2.raw
  modified_base (249)..(249): a, c, t, g, unknown or other
  misc_feature (249)..(249): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacaacacccaggcaaagccccaaactcatgatttttgatgtcagtaatcggccctcaggggtttctaatcgcttctctcggctcaagtctggcaacncggcctccctgaccatctcngggctccaggctgaggacgaggctgattattactgcagctcatatacaaccagcagcacttctgtattcggcggtaggaccaagcgtcgaccgttccgttggttccaagccctaaggccttcgccccctcggttctcccg

SEQ ID NO: 342483 - DNA, 591 bp, Homo sapiens
  misc_feature: GZ8MTXP01DOEZ8.10.29.C07.1.454.CMB.2.raw
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactntgtctctgtacaacacaccagacaaacgccccaaatcatgtattttgatgtacagtaactcggtacctgtagggtttacaagttcgtcttctctcggctcaagtctggaaccaacgcgcctcccngaccntctcgtcgggctcgaggcgtgaggacgaggtctagtattattacgngacacgactctaataacgtaacaaaccagacctaagacctcttcgtagttacgtccggggaacgggaacgggacccgtaggccgtacggtacccgttaccgttacggacccgaacggtaccccgaacgggccctcccggacccccgttcgggttccctaacccg

SEQ ID NO: 342484 - DNA, 570 bp, Homo sapiens
  misc_feature: GZ8MTXP01EX2KY.10.29.C07.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (367)..(367): a, c, t, g, unknown or other
  misc_feature (367)..(367): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacaacacccaggacaaacgcccccaaactcatgattttgatgtcagtaatcggccctcgtaggggtttctaatcgcttctctcggctcaagtctggacaacnccggcctccctgaccatctcgtcgggctccgaggcgtgaggacgaaggcttagattattacngtcagctanattanacaaccagcaagcaacttcgtgtacgttcgggcgggtaacgggacctaaaggcgtacggtaacccgttccgttacggccaacggcccaacgggcctcccggcccccgttcggttaacccgtaacccg

SEQ ID NO: 342485 - DNA, 601 bp, Homo sapiens
  misc_feature: GZ8MTXP01A1COU.10.29.C07.1.454.CMB.2.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatactntgtctctgtaccaacaacaccaggacaaacgaccccaaatcatgtattttgatgtcagtaatcggcctgtagggtttctatcgtcttctctcgctcagtctgacaacncgcctcctnaccntctcgtcgggcctcgaggcgtggacggacgaggtctagtatttacttacgtcgtacagtccttacaacttaactaaccaaaccacgcacgtcctaacgtttccgtacggttacggttcgggaacgggaacggggttaaccaacggttccgtaccggtacccgttaccggttcggttaccgaaccggcccgtaacgggccctcccggcccccgttcgggttccctaacccg

SEQ ID NO: 342486 - DNA, 545 bp, Homo sapiens
  misc_feature: GZ8MTXP01B1KSP.10.29.C07.1.454.CMB.2.raw
  modified_base (352)..(352): a, c, t, g, unknown or other
  misc_feature (352)..(352): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacacaccagcaaagccccaaactcatgattttgatgtcagtaatcggcctcaggggtttctatcgcttctctggctcaagtctggcacncggcctccctgaccatctctgggctccaggctgaggacgaggctgtattattactgcagctcatactaccaaccagcagactaccttgtgttaacgttcgggcgggaacgggacccaaaggccgtcggtacccgttcgttcgggttccaacgacccgaacggcctccggcccccgttcgggttccgtaacccg

SEQ ID NO: 342487 - DNA, 534 bp, Homo sapiens
  misc_feature: GZ8MTXP01CKA2G.10.29.C07.1.454.CMB.2.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (513)..(513): a, c, t, g, unknown or other
  misc_feature (513)..(513): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttanaactntgtctctgtaccaacaacaccagcaaacgccccaaatcatgtattttgatgtcagtaatcggccctcgtagggtttctaatcgtcttctctcggctcaagtctggacaacncggcctccctagaccatctctcgggctccgaggctgaggacgaggctgattatactgcagctanaattanaacaaccagcagactacttctgtatcgggaacggagggaccaaagcgtacgccgttcgaggttccaacgcccgaaggccnccgccccgtcggttctaaccc

SEQ ID NO: 342488 - DNA, 600 bp, Homo sapiens
  misc_feature: GZ8MTXP01AJC1C.10.29.C07.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaaccngcagtgacgttggtgttataactntgtctctgtaccaacaacaccaggacaaacgccccaaatcatgtattttgatgtacagtaactcggccgtcgggggtccctgactcgtcttctctcgctcagtcngacacncgccctccngaccatcnctcgcctcagcctgacgatgaggtctagtactttattacgttgttcgctacgtattagtgcgtaagggtcccggttacgtcggtttggggtacggtttccgggacgggaacgggtaaccaaggttccgtcggttaaccgtccgtaacgggttccgacggaccccgtaacgggcccgtcccggtcccccgttaccgggcctaacccgtttccgttaaccccg

SEQ ID NO: 342489 - DNA, 566 bp, Homo sapiens
  misc_feature: GZ8MTXP01CMACY.10.29.C07.1.454.CMB.2.raw
  modified_base (362)..(362): a, c, t, g, unknown or other
  misc_feature (362)..(362): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctggtaccaacaacacccagacaaacgcccccaaatcatgtattttgatgtcagtaatcggcctcgtaggggtttctaatcgcttctctcgctcagtctggcaacncggccctcctgaccatctcgtcgggcctccgaggcctggagggtacgaggtctagtattattactgactagctctaatactaaccaaacccgagcaagcctaacgtttctgtacgttcgggcgggtaacgggacctaaaggcgtaccggaccgttccgttacggcaacgcccgaacggcctccggcccctcggttccctaaccg

SEQ ID NO: 342490 - DNA, 570 bp, Homo sapiens
  misc_feature: GZ8MTXP01A9FMK.10.29.C07.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (366)..(366): a, c, t, g, unknown or other
  misc_feature (366)..(366): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttaataactntgtctctgtaccaacaacaccaggacaaacgccccaaatcatgtattttgatgtcagtaatcggtccctcgtagggggtttctaatcgtcttctctcggctcagtctggacacncgcctcctgacatctcgtcggctcgaggtctggacggacgagctagtattattactgacagtctacaattactaaccaaccagcacgctacttctagttacgttcgggaacggaacggacctaaagccgtacggacccgttcggttacggccgaaccgacccgaacggtcccgtccggcccccgttcgggttaacccttccccg

SEQ ID NO: 342491 - DNA, 505 bp, Homo sapiens
  misc_feature: GZ8MTXP01B0G70.10.29.C07.1.454.CMB.2.raw
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
  modified_base (489)..(489): a, c, t, g, unknown or other
  misc_feature (489)..(489): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccaggcaaagccccaaatcatgattttgatgtcagtaatcggcctcagggggtttctaatcgtcttctctcggctcaagtctggacaacncggcctccctgaccatctctgggctcgaggctgaggacgaggctgattatactgcagctanatatacaaaccngcagcacttctgattcggcggtagacgaagctgacgttcnggttcaagccaagcncgcccctggttcaacc

SEQ ID NO: 342492 - DNA, 536 bp, Homo sapiens
  misc_feature: GZ8MTXP01CRU95.10.29.C07.1.454.CMB.2.raw
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttaataactatgtctctggtacaacaacaccaggcaaacgccccaaactcatgattttgatgtcagtaaatcggcctctagggggtttctaaatcgcttctctcggctcaagtctggacaacaacggcctccctagaccatctctgggctcaggcngagacgagctgatattatgnancacatanaacaacacgacanactactctgtacgtcggaacgggaacgggacgaacgcgtacgtaccgttaccgttacgttacgaacgaccgaacgcgtccgccccgtccgttcgtcc

SEQ ID NO: 342493 - DNA, 578 bp, Homo sapiens
  misc_feature: GZ8MTXP01ELNDG.10.29.C07.1.454.CMB.2.raw
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacaacaccaggacaaacgccccaaatcatgtattttgatgtcagtaatcgcctgtagggtttctaatcgcttctctcgctacaagtctggaccaacgccggcctccctgacctatctcgtcgggctccgaggctgaggacgaggtctagtattagtactgaccagtctactaattaacacgaaaccagcagacctacttctagttacgttccgggaacggaacgggaccaaaggttctcggtaacccgttccgttagggttacccaacggaccccgaagggcccttccggcccccgttcggttcccgtaaccc

SEQ ID NO: 342494 - DNA, 653 bp, Homo sapiens
  misc_feature: GZ8MTXP01EWHQ0.10.29.C07.1.454.CMB.2.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtntacttataactatgtctctgtaccaacaacaccacgccacggcccccagactcatctatttcngtatgtcagtgattccggtccgtttggtactttacctaatcgtctttctctcgcctcaagtctcggaccaacgaccggtccttaccctcgacctacgttccgtccgggtccttacccgacgcgtacggaacgggacgacggtaccttacgtaactttaacggttaactggtaccacgtaccttacaacttaacgtaacccgaacccggacggggtaccctaacgttccgttaaccgtagttacgttacggttcggggaccgggaacggggttacccgttcgggaccgttaacggtaccccgttaacccgtaaccggttaccgaaccggaaccccgttaacggtccccg

SEQ ID NO: 342495 - DNA, 549 bp, Homo sapiens
  misc_feature: GZ8MTXP01A4QTL.10.29.C07.1.454.CMB.2.raw
  modified_base (250)..(250): a, c, t, g, unknown or other
  misc_feature (250)..(250): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacaacacccaggcaaagcccccaaatcatgatttttgatgtcagtaatcggccctcagggggtttctaatcgcttctctcggctcaagtctggacaacncggcctccctgaccatcnctgggctccgaggctgaggacgaggctgacttattacgngcagctactatacaaccgaacagcacgtactacttcgtcgttacgtcgggaacggaacggaccagcgtacgtacccggttcgttacggttcaacgacccgaacggccctccgccccgtcgttcctaacg

SEQ ID NO: 342496 - DNA, 585 bp, Homo sapiens
  misc_feature: GZ8MTXP01CP5T0.10.29.C07.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacgttggtgttataactntgtctctgtaccaacacaccagacaaacgccccaaatcatntattttgatgtcagtactcggcctgtaggttctatcgtcttctctcgctacagtctgaacacncgcctccnactntctcgcggctcgnggctaggacggacgaggtctagtactttacgtactgactagcctanaacttacaacccaaccgtagccagtacctactttcgtacgttcgttccggggaacggtacgggaccgtaaacgttccgtacggacccgttccgttacggttccaaccggacccgaacggtcccgtacccggttcccccgttaacgttcccgtaacccg

SEQ ID NO: 342497 - DNA, 563 bp, Homo sapiens
  misc_feature: GZ8MTXP01A27CU.10.29.C07.1.454.CMB.2.raw
  modified_base (250)..(250): a, c, t, g, unknown or other
  misc_feature (250)..(250): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtacaacaacaccaggacaaacgccccaaatcatgtattttgatgtacagtaatcggtcctgtaggggtttctaatcgcttctctcggctcaagtctggaacaacgcggccctccctcgaccactctcgtcgggtctccgaggcctggaacgacgaggcttaggtattatactgcgaagctactataactaacaaccagcgtagacctacttcgtgtacgttcgggaacggaacgggaccaacgcgtacggccttcggttaacgttccaacgcccgaaggcctccggcccctcggttctaacccg

SEQ ID NO: 342498 - DNA, 562 bp, Homo sapiens
  misc_feature: GZ8MTXP01DDD8M.10.29.C07.1.454.CMB.2.raw
  modified_base (290)..(290): a, c, t, g, unknown or other
  misc_feature (290)..(290): n is a, c, g, or t
  modified_base (360)..(360): a, c, t, g, unknown or other
  misc_feature (360)..(360): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttaataactatgtctctggtaccaacaacaccaggcaaacgccccaaacncatgattttgatgtcagtaatcggcctcgtagggttctaatcgcttctctcggctcaagtctggacaacncgcctccctgacccatcctctcgggctccgaggcgtagaggacgaggctgtacttattactgacagctacattaacacaaaccagccagctacttctagtacgttcgggaacgggaacgggacctaagcgtacggcccgttacgttacggttaccgaacggccccgaaggtcctccggttcccccgtcggttcgtaaccccg

SEQ ID NO: 342499 - DNA, 557 bp, Homo sapiens
  misc_feature: GZ8MTXP01DPNF7.10.29.C07.1.454.CMB.2.raw
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttatactatgtctctgtaccaacaacaccagcaaacgccccaaactcatgtattttgatgtcagtaatcggtccctgtaggggtttctaatcgtcttctctcggctcaagtctggacaacncggcctccctgacctatcgttgggctccagctgagacgaggctgattattacgngcatctacgtaactaactaaccaacacgacacgtactacttcgtagtacggtcgggacgggaacggtaaccaggtccgttacgtaccgtcgttacgccgaccgaaccgacgtccgtcccgtccccgttcgtccttccgtcc

SEQ ID NO: 342500 - DNA, 581 bp, Homo sapiens
  misc_feature: GZ8MTXP01BJPUB.10.29.C07.1.454.CMB.2.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctgtacaacacaccagacaaacgccccaaactcatgtattttgatgtcagtaactcggcctcgtagggtttctaatcgtcttctctcggctacaagtctggaaccaacgcggtccctcccgtgaccctatctcgtcgggctcgaggctggacggcgtagggcttagacttagtactgctagccgtataataactaaccgaacagcacgtctaacttcgtagtacgtcggggaacggtacgggaccaacggctacggacccgttccgttaggttacccgaacgccccgaaggtcccgtccggttcccccgtgggttccctaacccg

SEQ ID NO: 342501 - DNA, 542 bp, Homo sapiens
  misc_feature: GZ8MTXP01EFXXQ.10.29.C07.1.454.CMB.2.raw
  modified_base (250)..(250): a, c, t, g, unknown or other
  misc_feature (250)..(250): n is a, c, g, or t
  modified_base (363)..(363): a, c, t, g, unknown or other
  misc_feature (363)..(363): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttataactntgtctctggtaccaacaacacccaggcaaacgcccccaaatcatgattttgatgtcagtaatcggccctgtagggtttctaatcgtcttctctggctcaagtctggaccaacncggccctccctgacccatctcgtgggcctcgaggctggaggacgaggctgacttattactgcagctcatatacaaccagcagctacttctagtacgttcgggaacggagggaccaacgttcgtcgtaccgttcgttacggttcaacgcccaacggcctcgccccgtcggttctaacccg

SEQ ID NO: 342502 - DNA, 562 bp, Homo sapiens
  misc_feature: GZ8MTXP01C62R9.10.29.C07.1.454.CMB.2.raw
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
  modified_base (455)..(455): a, c, t, g, unknown or other
  misc_feature (455)..(455): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttataactatgtctctgtaccaacaacaccaggacaaacgccccaaatcatgtaattttnatgtacagtaatcggccctcgtagggttctaatcgtcttctctggcctacagtctggaccaacnccggtcctccctgaccctatcctcgtcgggcctccgaggctggaggacgaaggcttgtattatactgacagctacaataactaacaacngacagacctcttacgtgtacgtcgggaacggaacggaccaaggcgtacgacccgttcgttacgttccaacgcccgaaggtccctaccggccccttcggcccttaacc

SEQ ID NO: 342503 - DNA, 564 bp, Homo sapiens
  misc_feature: GZ8MTXP01DLVPR.10.29.C07.1.454.CMB.2.raw
  modified_base (227)..(227): a, c, t, g, unknown or other
  misc_feature (227)..(227): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagcatagtagtgcacgaccggtgctcgatttagagtgctacgaaggggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtagttataactatgtctctgtaccaacaacaccagcaaacgccccaaatcatgattttgatgcagtaatccggcctacgtagggtttctaatcgtcttctctcggctcaagtctgaacacncgcctcccngcatctnggcncnggctggagngaggctgtattatctgcgacnctactaataactaaccaaccagacacgtacctacttcgttacggtacgttcggggaacggtaacggaacctaacggctaccggtaccgttaccgttcggttaccgaacgtacccgaacggtcccgccgttccccgtcggttccttaacccg

SEQ ID NO: 342504 - DNA, 721 bp, Homo sapiens
  misc_feature: GZ8MTXP01D241C.10.29.C07.1.454.CMB.2.raw
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgtacgttggtgttaataactatgtctctgaaccaacaacaccagcaaacgccccaaatcatgtatttgatgtcaagtaactccggcctacgtagggtttactacgtcgtcttcgtctcggcctacgagtcgtacgaacccaacgtcccggtccctaccccgtacgtaaccctacttccgtcggtccgggtcctccgtaacgggtcgtaacgggacgggtaaccggaagggttccttaagggttaacttttaacgttaaccgtgaaccgtacgttaccgtaaactaaggtttaaaccctaaacccgaaaccaacggaccgtaacgttaacccgttaaccttttccggttaacgttaacggggttccgggggaaacgggttacggaaaccgtacggttaccgtaccgggtaacccgtttaccggttcggttaaccgaacccggtcccgtaacggccccgtccgaccccccgtttgggaacccctttccccgg

SEQ ID NO: 342505 - DNA, 637 bp, Homo sapiens
  misc_feature: GZ8MTXP01C95T1.10.29.C07.1.454.CMB.2.raw
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcacgtggaaaccagcagtgtacggttggtagttaataactntgtctctagtaccaacaacaccagacaaacgacccaaactcatgtattttgatgtacagtaactccggccttcgtaggggtttctatcgtcttctcgtcgctcagtctgaaccacnccgcctccctacgaccnctctcgtcggtcctcgacggcgtaggacggacgaggtcgttagtaacgtttaactacgtgactacgtacttactaattaaacctaaaccaaaccgacgacctacggtaccttacgtttccgttaggttacggttcggggaacgggaacggaccgtaaacgcgttaaccggtcccggttaccgttcggttaccgaaccgtacccggaacggtcccgtcccggttccccgttcggttcccgtttaaccccg

SEQ ID NO: 342506 - DNA, 593 bp, Homo sapiens
  misc_feature: GZ8MTXP01BGEIB.10.29.C07.1.454.CMB.2.raw
  modified_base (253)..(253): a, c, t, g, unknown or other
  misc_feature (253)..(253): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagcatagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgtacgttggtagttataactntgtctctggtaccaacaacaccaggacaaacgcccccaaatcatgtattttgatgtacagtaactccggtccctcgtaggggttttactattccgtcttctctcggcctcaagtctggacaacgtccgcctcccgtgacctatctcgtcggcctcgaggtcgaggaggacgaaggtctaggtattacttacnggactcgctaanacttaaacacccgaaaaccgcgactacgtacttacgttcgtagtacggtcgggaacggtaacggaccgacgttcgtacgtaccgttacgttacgaccgaacgtccgaacgccgtcccgttcccgtccgttcctccg

SEQ ID NO: 342507 - DNA, 555 bp, Homo sapiens
  misc_feature: GZ8MTXP01D9FUI.10.29.C07.1.454.CMB.2.raw
  modified_base (356)..(356): a, c, t, g, unknown or other
  misc_feature (356)..(356): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (532)..(532): a, c, t, g, unknown or other
  misc_feature (532)..(532): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtacaacaacaccaggcaaagccccaaatcatgattttgatgtcagtaatcgcctgtagggtttctatcgtcttctctcggctcaagtctggacaacncggcctcccgtgaccatctcgtcgggctccgaggctaggaggacgaggctagtattattacngcagtctactatactaaccacngacacgtactacttcgtgttacgtcgggaacgggtaacggaccgaagttcgtacgtaccgttcgttacgttacgaacgaccgtaacggtccncccgttccccgtcgttccgtccg

SEQ ID NO: 342508 - DNA, 550 bp, Homo sapiens
  misc_feature: GZ8MTXP01BPM46.10.29.C07.1.454.CMB.2.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcncctgcactggaaccngcagtgacgttggtagttanaactntgtctctgtacacaacaccagcaaacgccccaaatcatgattttgatgtcagtaactcggcctgtaggggtttcatcgtcttctctcggctcaagtctggacaacncggcctccctgacctatctcgtgggcctaccgaggtcgtggagggacgagggctagtattagttactgcagctnatanacgaccngctagctactctgtacgtcggcggacggaccaaggcgtacgaccgttccgttacggccgaacggccccgaagggcccttccggcccccgttcgggttcccttaacccg

SEQ ID NO: 342509 - DNA, 504 bp, Homo sapiens
  misc_feature: GZ8MTXP02IERG2.10.29.C07.1.454.CMB.2.raw
  modified_base (248)..(248): a, c, t, g, unknown or other
  misc_feature (248)..(248): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (461)..(461): a, c, t, g, unknown or other
  misc_feature (461)..(461): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgtataactntgtctctggtaccaacaacaccaggcaaagcccccaaatcatgattttgatgtcagtaatcggcctnaggggtttcaatcgcttctctggctccaagtctggcaacncggccctcctgaccatctctgggctcagctgaggacgagctgattatactgcagctacatatacaaccagcagctacttctgtattcggcggagggaccaaagtcncgaccgtctaggtcaagcccaaggctcgccccctggtcctacc

SEQ ID NO: 342510 - DNA, 516 bp, Homo sapiens
  misc_feature: GZ8MTXP02FM0KI.10.29.C07.1.454.CMB.2.raw
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccaggcaaagccccaaactcatgattttgatgtcagtaatcggccctcaggggtttctaatcgcttctctcggctccaagtctggcaacncggcctcctgaccatctctgggctccaggctgaggacgaggctgattatactgcagctcatatacaaccagcagcacttcngtacttcggacggagggaccaaagctacggaccgtctagggtcaagccccaaggcctcgccccctcggtctaccg

SEQ ID NO: 342511 - DNA, 520 bp, Homo sapiens
  misc_feature: GZ8MTXP02H7VVV.10.29.C07.1.454.CMB.2.raw
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagccccaaactcatgattttgatgtcagtaatcggccctnaggggtttctaatcgcttctctcggctccaagtctggcaacncggcctccctgaccatcnctgggctccaggctgaggcgaggctgattattactgcagctcgatatacaaccagcagcacttctgtacttcggcggagggaccaaagctacgaccgtcctaaggtcaagcccaagggcctcgccccctcggttcacccg

SEQ ID NO: 342512 - DNA, 492 bp, Homo sapiens
  misc_feature: GZ8MTXP02IU6YM.10.29.C07.1.454.CMB.2.raw
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacataggtgcttataactatgtctcctgtaccaacaacacccagccaggcccccagactcatcatttctgatgtcagtgatcggcctttgggatttctaatcgcttctctgcctcagtctggcaacacgcttcctgaccatctccggctccacgctgagacgaggctcattattactgcagctcatatacaccagggcactctcgtgatattcggcggagggaccgtggctgaaccgtcgtacgtcacgccaacgctcccg

SEQ ID NO: 342513 - DNA, 521 bp, Homo sapiens
  misc_feature: GZ8MTXP02GP9DE.10.29.C07.1.454.CMB.2.raw
  modified_base (241)..(241): a, c, t, g, unknown or other
  misc_feature (241)..(241): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacataggtncttataactatgtctcctggtaccaacaacacccaggccaggccccagactcatcatttctgatgtcagtgattcggccctttgggtatttctaactcgtcttctctcgcctcacgtctggcaacacgcttccngaccatctccggctccacgctgacggacgaggctctattattactgcanactcaactactaccaccgagggcactcgccgtacgatagttcggcgggacgaccgtcggctcgaaccgtccgtacgtcacgaccgaacgctccccgg

SEQ ID NO: 342514 - DNA, 548 bp, Homo sapiens
  misc_feature: GZ8MTXP02IB17K.10.29.C07.1.454.CMB.2.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggcaaacgccccaaactcatgattttgatgtnagtaatcggcctcgtaggggtttcaatcgtctttctctcggctccagtctggcaacncggcctcctgaccatctctgggcctcgaggctggacggacgaggctgtaattattacgtgcagctacatactacaaccngcagctacttctagtacgttcggacggacgggaccaagccgtacgtaaccgtccgttaacggccgaacgcccgaacggcctccgccccccgttcggtaccctacccg

SEQ ID NO: 342515 - DNA, 543 bp, Homo sapiens
  misc_feature: GZ8MTXP02HTAK3.10.29.C07.1.454.CMB.2.raw
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtggttataactatgtctctgtaccaacaacaccaggacaaacgccccaaactcatgtattttgatgtcagtaatcggcctcgtaggggtttctaatcgcttctctcgctccaagtctggacaacgcgcctccctcgaccatctctcgggcctcaggctgacggacgagctagtattaattctgctagctanatatacaaccngcagctattctgtagttcggcggtagggaccaagctacgacccgtcgtaacggtccaacggtaccccgaaaggtccctccggtcccccgtacggtacctcccg

SEQ ID NO: 342516 - DNA, 507 bp, Homo sapiens
  misc_feature: GZ8MTXP02G0XFD.10.29.C07.1.454.CMB.2.raw
  modified_base (226)..(226): a, c, t, g, unknown or other
  misc_feature (226)..(226): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggctcagtctgccctgactcagcctgcctccgtgtctgggtctcctggacagtcgatcaccatctcctgcactggaaccngcagtgacgttggtgttataactatgtctctggtaccaacaacacccaggcaaacgcccccaaactcatgattttgatgtcagtaatcggccctcgaggggtttcaatcgcttctcctggctcaagtctggcacacgctccngaccatcnctggctccgagctgagacgaggctgacttatactgcagctcatatacaaccagcagcacttctgtacgtcggacggacggaccaagctacgaccgtcgaggtcacgacccaaggcctcgcccctacggtcc

SEQ ID NO: 342517 - DNA, 720 bp, Homo sapiens
  misc_feature: GZ8MTXP02JXGEV.10.29.C07.1.454.CMB.2.raw
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcatcactatctcctgcactggcaccagcagtgacatagggtnacttaataactatgtctcctggtaccaacaacacccaggccacggccccagactcatcatttcngattgtcagtgacgttccggtcccgtttggggtacttttaccctaaacgttccgtcctttcctcgttcggccccttccgtaaacggttcttacggggacctaaaccgtaacccgggtccttttacccccgtacggtaacccctaacgttcccggttaacccccgggggcccttaccccgaaccggccgttacgggaaccggggtaaccggaacgggtcccttacgttaaactttaacggtttaaccttcgacctacggtacctactaaacttacgtaacccgacccgtacgggggacctaaccgtcgttccggtagtacgttacggttaccggggacgggtaacgggccgttacgggcctaacggtaccccgttaccgttaaccggtccaaccggaccccgtaacgggtcccccg

SEQ ID NO: 342518 - DNA, 523 bp, Homo sapiens
  misc_feature: GZ8MTXP02JZMRW.10.29.C07.1.454.CMB.2.raw
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccattctgccctgactcagcctgcctccgtgtctgggtctcctggacagtcgatcaccatctcctgcactggaaccagcagtgacgttggtgttataactatgtctcctggtaccaacaacacccaggcaaagcccccaaactcatgattttgatgtcagtaatcggccctnaggggtttctaatcgcttctctggctcaagtctggcaacncggcctccctgaccatctctgggcctccgaggctgaggacgaggctgattattactgcagctcatatacaaccagcagcacttctagtagtcggacggaggaccaagctcgaccgtccgtaggtcaacgcccaaggcctcgcccccgtacggtaacttcccg

SEQ ID NO: 342519 - DNA, 568 bp, Homo sapiens
  misc_feature: GZ8MTXP02F7P0Q.10.29.C07.1.454.CMB.2.raw
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggacaaacgcccccaaatcatgtattttgatgtcagtaatcggccctgtaggggtttctaaatcgcttctctcgctccaagtctggacaacnccggcctccctgaccatctcgtgggctcgagctgaggacgagctagtacttatacngtacagtctacattactaaccaaacacgacagactacttctagttaacgttccgggacgggaacgggaaccaaacggtccgtacggtacccgtaccgtaggtaccaacggaccccgaacggcctccgacccccgttcggactacccg

SEQ ID NO: 342520 - DNA, 576 bp, Homo sapiens
  misc_feature: GZ8MTXP02GA3IL.10.29.C07.1.454.CMB.2.raw
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctgtaccacacaccagacaacnccccaatcatgtatttgatgtcagtaatccggtcctgtacgggtttctaagtcgtcttctctcggtacctccgaagtcgtacggacctaaacgcccggtccctacccgtgaccctactctcgtcgggccttaccgacggctaggacgggacgtaggcttagtaatttactacgtgactaagtcctataactactaaccgaaccagctacgctacttgtagttacgtcgggacggacggactacgacgtcgaccgtcgtagtccgaacgccgtaacgcctccgtccccgtggtacctccg

SEQ ID NO: 342521 - DNA, 553 bp, Homo sapiens
  misc_feature: GZ8MTXP02FFQLQ.10.29.C07.1.454.CMB.2.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (367)..(367): a, c, t, g, unknown or other
  misc_feature (367)..(367): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactntgtctcctgtaccaacaacaccaggacaaacgccccaaactcatgtattttgatgtcagtaatccggccctcgaggggtttctaatcgcttctctcggcctccaagtctggccaacncgccctcctgaccatctctgggctccgaggctagaggaccgaggctagtaattattacgtgcagctcaatactacaacagacacgctactctagttagtcggcgggacggaccaaagcctacggacccgtacgtacggtaccaacgtcccgaacgggtccctccgcccccgtacggttcctacccg

SEQ ID NO: 342522 - DNA, 643 bp, Homo sapiens
  misc_feature: GZ8MTXP02GWQKM.10.29.C07.1.454.CMB.2.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
tcagcatagtagtgcacgaccggtgctcgatttagagtgctacgaagggaaagggggggtctcaggaggcagcgctctcgggacgtctccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacttttgtncttataactntgtctcctggtaccagcaccaccaggacaaacgccccaaactccttgttttgagtcagtaagcgccctnaggactccctgacttccgttctctcgcctccccgaagtctggactaacgaccggccctccctcgacccttctcgtcgggctccgagctgaggactgaggctagacttactactgcacgtcgctaatacttcgacgtacccccgaagtacgggttcgtttcggggacggacggggtaacgttaaacgggtcgtaacccggttccgtcgggggttaccaccggaccccgtaaacgggtccctacccggtcccccgttcgggtccccaaccgtttcccgttcccggttaccccctacccccgtttcccctacccgttaaaccccg

SEQ ID NO: 342523 - DNA, 572 bp, Homo sapiens
  misc_feature: GZ8MTXP02HULPZ.10.29.C07.1.454.CMB.2.raw
  modified_base (248)..(248): a, c, t, g, unknown or other
  misc_feature (248)..(248): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagcatagtagtgcacgaccggtgctcgatttagagtgctacgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttataactntgtctctgtaccaacaacaccaggacaaacgcccccaaaactcatgtattttgatgtcagtaactccggccctgtagggtttctaatcgtcttctctcgctccagtctgcacncgcctccnaccatctctcgggctccgagctgaggacgaggctgaatttatactgactagctactaatactaaccaaacccagacacgtacctactttcgtgttaacggttcggacgggaacgggaccaaagccgttacggaacccgttccgtaacgggtaccaacggacccccgaaggtccccgtccggtccccccgttcggtaccctccg

SEQ ID NO: 342524 - DNA, 543 bp, Homo sapiens
  misc_feature: GZ8MTXP02IZIKE.10.29.C07.1.454.CMB.2.raw
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataangaatatgtctcctggtacacagtaccaggcaaagcccccaaatgatgtatttatgatgtcagtaatcgaccctgagggtttctgatcgtcttctttcgcctcagtctggcacncgcctccngaccatctcgtggctcagacgtgagacgnggctgtattatctgcagctcacgataacgaacgcggacaggtcgggttggggtcggttcggggcgggggaccacgtacgtcggtaccgtccgtacggtacacgtacccgaaggccgttccgcccccgtggtcctacgtccgtttcccg

SEQ ID NO: 342525 - DNA, 547 bp, Homo sapiens
  misc_feature: GZ8MTXP02J2086.10.29.C07.1.454.CMB.2.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctggcccagtctgccctgactcagcctgcctccgtgtctgggtctcctggacagtcgatcaccatctcctgcactggaaccagcagtgacgttgtgttanacntgcnctgtaccacaacnccaggaacaacgccccaaactcatgtnttttgatgtcagtaatccggcccttcgtaggggtttttctaactcgtcttctctcggctcatctggcaacncggccctccctcgaccatctcgtgggctccaggctggagacgagctgaatttntactgcagtctnattacaaccaccgaacncanctacttcttagttagttacgggacggacggaccgaacgtacgtacgtaccgtaccgtacgtacgaacgaccgacgtccgtcccgtccccgtccgtacctcc

SEQ ID NO: 342526 - DNA, 512 bp, Homo sapiens
  misc_feature: GZ8MTXP02IXD3V.10.29.C07.1.454.CMB.2.raw
  modified_base (249)..(249): a, c, t, g, unknown or other
  misc_feature (249)..(249): n is a, c, g, or t
  modified_base (355)..(355): a, c, t, g, unknown or other
  misc_feature (355)..(355): n is a, c, g, or t
  modified_base (413)..(413): a, c, t, g, unknown or other
  misc_feature (413)..(413): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactntgtctctggtaccacaacaccaggcaaagccccaaatcatgtattttgatgtcagtaatcggccctcaggggtttctaatcgcttctctgctccagtctggcaacncggcctccctgaccatctctggctcaggctgagacgaggctgattatactgcagcctnatactacaaaccagcagtcactttctagtattcggcggtacggaccaagctggaccgtcctaggtcaacgcccaagggcctacgccccctcggtctacc

SEQ ID NO: 342527 - DNA, 501 bp, Homo sapiens
  misc_feature: GZ8MTXP02JV51K.10.29.C07.1.454.CMB.2.raw
  modified_base (360)..(360): a, c, t, g, unknown or other
  misc_feature (360)..(360): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggcaaagccccaaactcatgatttttgatgtcagtaatcggccctcaggggtttctaatcgcttctctggctccaagtctggcaacncggcctcctgaccatctctgggctccaggctgaggacgaggctgattatactgcagctcatatacaacagcagcacttctgtatcggcggaggaccaagctcgaccgtctagtcaagccgaagctcgcccctcggctaccg

SEQ ID NO: 342528 - DNA, 640 bp, Homo sapiens
  misc_feature: GZ8MTXP02GUZ0V.10.29.C07.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanaactntgtctctggtaccaacaacacccaggacaaacgcccccaaactcatgattttgatgtcagtatcggccctcgaggggtttctaagtcgcttctctcgctccaagtctggaccaacaccggcctccctagaccctatctcgtcgggcctcgacggctacggaggtaccgaaggtcctaggtaactttaacgttacgtggacctaacgtctacctaataacttaaccaaacccaggaccacggaccttaactttcgtacgttaagtttccggggacgggtaacgggaacccgtaaacgccgttacggacccgttcccgttaagggtaccaaccggaccccaaacgggggtccttacccggaccccccgttcgggttaccctttaacccccgg

SEQ ID NO: 342529 - DNA, 544 bp, Homo sapiens
  misc_feature: GZ8MTXP02F9S3E.10.29.C07.1.454.CMB.2.raw
  modified_base (361)..(361): a, c, t, g, unknown or other
  misc_feature (361)..(361): n is a, c, g, or t
  modified_base (417)..(417): a, c, t, g, unknown or other
  misc_feature (417)..(417): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctgtaccaacaacacccaggcaaacgcccccaaactcatgattttgatgtcagtaatcggcctcaggggtttctaatcgcttctctgctcaagtctggccaacnccggcctccctgaccatctcgtcgggctccgagctgaggacgagctgattattacngacagctcatatacaaccagcagctaacttctagtagttcgggacggtacggaaccaacgcgtacggtaccgttaccgtaacgggtcaacggcccgaaacgcctccggccccctcggtacctacccg

SEQ ID NO: 342530 - DNA, 569 bp, Homo sapiens
  misc_feature: GZ8MTXP02JKD2U.10.29.C07.1.454.CMB.2.raw
  modified_base (367)..(367): a, c, t, g, unknown or other
  misc_feature (367)..(367): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacaacaccaggcaaacgcccccaaactcactagtattttgatgtcagtaatcggtccctcgtaggggtttctaatcgtcttctctcggctcaagtctgcaacncggcctccctgacctatctcgtgggacctcgaggctggacggtacgagctgtaagttatacgtgcagctcgaatatacaacagacacgctacttcgtagtacgttcggaccggtaagggaccaaacgtccgtacggtacccgttaccgtaacggtcgaacgtccccgaaaggccctaccgcccccggttacgtccgtacccg

SEQ ID NO: 342531 - DNA, 655 bp, Homo sapiens
  misc_feature: GZ8MTXP02I3UET.10.29.C07.1.454.CMB.2.raw
  modified_base (226)..(226): a, c, t, g, unknown or other
  misc_feature (226)..(226): n is a, c, g, or t
  modified_base (406)..(406): a, c, t, g, unknown or other
  misc_feature (406)..(406): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctgtaccacaacaccagacaacgccccaaatcatgtatttgatgtctagtactccggcctcgtagggtttctacgttctcttctcgtcgtctccagtctcggacaacgaccggccctcctacgacctagtcctcgtccgggtcctaccgnggtctaggaacggtcgaggtctagtactttacgtactcgacgtacgtactaccgtaaattaaacctaaccaaacccacggtaccgaacgtaccttaaccgtttccggttacggttaccggttaccgggggaaccggggtaaacgggtaacccgaaacggttccggtacggtaccccgttacgtaccggtccgaaccggacccgaacggtccctacccggtacccccgttacggttaaccctttccccgg

SEQ ID NO: 342532 - DNA, 541 bp, Homo sapiens
  misc_feature: GZ8MTXP02JT8FX.10.29.C07.1.454.CMB.2.raw
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
  modified_base (453)..(453): a, c, t, g, unknown or other
  misc_feature (453)..(453): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactntgtctcctggtaccaacaacacccaggcaaacgtccccaaactcatgtattttgatgtcagtaatccgcctcgtaggggtttctaagtcgtcgtttctctcggctccaagtcgtggcaacnccgggtccctccctacgacctatcgtcgtcgggctccgagcctggaggcgagctgtattactatgcagtctcatagaccaacngcaagctacttctagtagtcggacggacggacgaagctacggtaccgcgtggaccaagcccgtaacggctccgcccctcggctacccg

SEQ ID NO: 342533 - DNA, 663 bp, Homo sapiens
  misc_feature: GZ8MTXP02H07QF.10.29.C07.1.454.CMB.2.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (341)..(341): a, c, t, g, unknown or other
  misc_feature (341)..(341): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacgagggtcctgggcccagtctgccctgactcagcctgcctccgtgtctgggtctcgtggacagtcatcaccatcctctgcagtgaaccagcagtgtacgttggtagttaanaactntgtctcctgtaccaacacaccaggacaaacgccccaaatcactgtattttgatgtacagtactcggcctgtagggtttcaatcgtctcnctcgctaccagtctacggcaaccgcgacccgtctacgacctatccgcgtcggcctaccgagccgtaggacggacgaggtactgtaacttacgttacgtcgacgtatctaactacttaacaacccgaccggtaagggaccctacgttccgtacggttgtaacgttacgttaccgggggtacgggaaaccgggggtacccgttcgggtaaccccggttcgggtaacccccgtacccggtttaccggtaacccgtaacccggacccgtaaaaccggggtcccccgttcccggtccccccggttaaccggttcccttaacccccgg

SEQ ID NO: 342534 - DNA, 554 bp, Homo sapiens
  misc_feature: GZ8MTXP02FHR49.10.29.C07.1.454.CMB.2.raw
  modified_base (252)..(252): a, c, t, g, unknown or other
  misc_feature (252)..(252): n is a, c, g, or t
tcagcatagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttaataactntgtctctgtaccaacaacacccaggcaaagcccccaaactcatgtattttgatgtcagtaactcggcccctcgtaggggtttctaaatcgcttctctcggcctccaagtctggcaacacggccctccctgaccatctctggcctccaggctggacgacgagctagattatactgcagctacatataacaaccagcagctacttcgtgtagtcgggcggacgggtaccaaacggcctacggacccgtaccgtacggtaccgaacgtacccgaaacggcctaccgcccccgtcggtcctacccg

SEQ ID NO: 342535 - DNA, 502 bp, Homo sapiens
  misc_feature: GZ8MTXP01C3D80.4.74.G08.1.454.CMB.2.raw
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (340)..(341): a, c, t, g, unknown or other
  misc_feature (340)..(341): n is a, c, g, or t
  modified_base (408)..(408): a, c, t, g, unknown or other
  misc_feature (408)..(408): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaanctggtatcagcaagaaaccagggaaancccctaaagctcctgactctacgctgcgttctagtttacagagtgacgtccccatcaaggtcagcgnngtgatcgtggcacagatttcactctcaccatcagcagcctgcagcctgagggtatttgactaacttntactgtctaacgatattacacttacccgtgggtacttcggacaaagggaccaagggttagaaattacgaaagtaactgtggacttcgcaactaa

SEQ ID NO: 342536 - DNA, 523 bp, Homo sapiens
  misc_feature: GZ8MTXP01DRF5Y.4.74.G08.1.454.CMB.2.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (339)..(339): a, c, t, g, unknown or other
  misc_feature (339)..(339): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaancnggtatcagcagaaacaggaaancccctaaagctctgatctacgctgcgttctagtttacagagtggacgtcccccatcaaggttcagcggcngtggatctggcacagtatttcactctcaccatcagcagcctgcagcctgaggggtattttgactaacttattctgtctaacaagtattaactactttacccgtaagggtacgtttcggaccgaaaggggtaaccaagggttaaggaaattacgaaacggtaaactgttaggcttgtcaacctaa

SEQ ID NO: 342537 - DNA, 507 bp, Homo sapiens
  misc_feature: GZ8MTXP01A7XA6.4.74.G08.1.454.CMB.2.raw
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaaatgaggtaagcnggatcagcagaaaccaggaaancccctaagctcctgatctacgctgcgtctagtttacagagtggagtcccccatcgaaggttcagcgcngtggatctggcacagtattcactctcaccatcagcagcctgcagcctgacggggtattttgactaacttattctgtactaacagtacttaactcttaccctggggtaccgttcggaccgaaagggaaccaagggttacggaaattacaaagactgtggcttgcaacgtaac

SEQ ID NO: 342538 - DNA, 516 bp, Homo sapiens
  misc_feature: GZ8MTXP01DVP5N.4.74.G08.1.454.CMB.2.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccagggaaacncccctaaagctcctgatctacgctgcgtctagtttacagagtgagtcccccatcaaggttcagcggcngtggatctgggcacagtactttcactctcaccatcagcancctgcagcctgagggtattttgactaacttattactgtactaacaagtattacacttaccgtgggtacgttcggaccgaaagggacccaagggttacggaaattacgaaaacgtactgtggcttgccaactaac

SEQ ID NO: 342539 - DNA, 535 bp, Homo sapiens
  misc_feature: GZ8MTXP01C4DG9.4.74.G08.1.454.CMB.2.raw
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
  modified_base (528)..(528): a, c, t, g, unknown or other
  misc_feature (528)..(528): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacncccctaaagctcctgatctacgctgcgttctagtttacagagtggacgtcccccatcaaggtcagcggcnggtggatctggcacagtatttcactctcaccatcagcagcctgcagctgaggggtnttttggactaacttatactgtactaacaagtacttactaccttacccgtgggtaccgttcgggaaccgaaaggggtaaccaaggggttaacgaaacttacgaaacgtaacgtggtacggcttgaaccncgtaacg

SEQ ID NO: 342540 - DNA, 521 bp, Homo sapiens
  misc_feature: GZ8MTXP01A9PK0.4.74.G08.1.454.CMB.2.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagcnggtatcagcaagaaaccagggaaacncccctaaagctcctgatctacgctgcgttctagttacagagtgagtcccccatcaaggttcagcggcngtggatctggcacagtatttcactctcacatcagcagcctgcagcctgaggggtattttgactaactttattactgtctaacaagtattacctactttacccgtggggtaccgttcgggaccaaagggacctaagggttacggaaattacgaaacgactggtaggattcgcaaccgtaa

SEQ ID NO: 342541 - DNA, 684 bp, Homo sapiens
  misc_feature: GZ8MTXP01BZN02.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (354)..(354): a, c, t, g, unknown or other
  misc_feature (354)..(354): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacataccgaaatgaggtaanctggtatcagacaagaaaccagggaaacncccctaaagctcctgactctacgctgcgttctagttacaggtagtggacgtcccccatacgaaggttcaggacggacnggtgggaatcgtagggaccaacgtagtacttttacaaccttctaccaacctattcaacggccaagcccgtagaccgaacggtcccgttagggtaacgggggttaattttttacggaaccttaaacgttttaacgttaaccttacgttaacttaaacgtaaacgttaacctttaaaccttacccgtttaaccccgggtaacggggtaacccggtttaccgggaaacccggttaaacggggaaacccgtaaaggggttaacgggaaaacttaaccgtaaaaacggtaaccgtaaggttacggggaccttacggaacccgttaacccgttaag

SEQ ID NO: 342542 - DNA, 529 bp, Homo sapiens
  misc_feature: GZ8MTXP01AKIBQ.4.74.G08.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaanctggtatcagcaagaaaccagggaaacncccctaaagctcctgatctacgctgcgttctagtttacagagtgacgtcccccatcaaggttcaggcggcaaggtgatcgtggacacagtatttcactctcaccatcagcagcctgcagcctgaggggtatttgactaactttattactgtactaacaagtacttactacctttacccgtggggtacgttcgggaccgaaagggaaccaagggttaggaaacttacgaaacgactaaggtggcttgcaacgtaac

SEQ ID NO: 342543 - DNA, 506 bp, Homo sapiens
  misc_feature: GZ8MTXP01DOM0J.4.74.G08.1.454.CMB.2.raw
  modified_base (271)..(271): a, c, t, g, unknown or other
  misc_feature (271)..(271): n is a, c, g, or t
  modified_base (334)..(335): a, c, t, g, unknown or other
  misc_feature (334)..(335): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaagctggtatcagcaagaaaccaggaaancccctaaagctcctgatctacgctgcgtctagtttacagagtgatcccccatcaagtcagcgnngtgatctgcacagatttcactctcaccatcaagcagcctgcagcctgagggtatttgactaacttattactgtactaactaagtacttacaccttccgtaagggtacgttcggaccgaaagggaccaagggttacgaaattacgaaacgtaacgtgtaggcttgcaactaa

SEQ ID NO: 342544 - DNA, 550 bp, Homo sapiens
  misc_feature: GZ8MTXP01DL6M2.4.74.G08.1.454.CMB.2.raw
  modified_base (277)..(277): a, c, t, g, unknown or other
  misc_feature (277)..(277): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccgggcaagtcaggacatccgaaatgaggtaagctggtatcagacaagaaaccgagggaaacncccctaaagcctactgactctacgctacgtctagttacagagtggatcccatcaagtcagcgacagtggatctggcacgagtatttcactctcaacatcagcacgctgcagcgtagacggttattttcgacttaaacttattactgtactaactaaagtactttaacaccgttacccgtgggtaaccgttcggaccggaaagggaccgtaaagggtcggttaaaaacttccgaaaacggtaactaggtcggctagacctaacgttaactttcg

SEQ ID NO: 342545 - DNA, 514 bp, Homo sapiens
  misc_feature: GZ8MTXP01AFGGD.4.74.G08.1.454.CMB.2.raw
  modified_base (194)..(194): a, c, t, g, unknown or other
  misc_feature (194)..(194): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccggacaagtcagacatacgaatgagtaagctgtatcagcaagaaacaggaaacgcccctaagctctgactcacgctgctctagttacagagtgacgtcccccatcgaaggttcacgcggcaagtgggatcgtggactacgataacttcaactctacacatcagcacncngcgacgactgaggtattactactaacttattactactactaactaactacttactaccgttaccgtcggtacgttacggtacgaacggaacgtaagagaacgaacgaacgacgtcgtcgtcgacgtcgctc

SEQ ID NO: 342546 - DNA, 505 bp, Homo sapiens
  misc_feature: GZ8MTXP01D6YRR.4.74.G08.1.454.CMB.2.raw
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (501)..(501): a, c, t, g, unknown or other
  misc_feature (501)..(501): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaanctggtatcagcaagaaaccagggaaacncccctaaagctcctgatctacgctgcgtctagtttacagagtggagtcccccatcaaggttcagcggcaaggtggatctggcacagtatttcactctcaccatcagcagcctgcagcctgaggggtatttgactaacttatactgtactacaagtacttacacttaccgtggacgttcggacaaagggacaaggttaggaaattacgaaacgaatgtaggcttagcnctaa

SEQ ID NO: 342547 - DNA, 526 bp, Homo sapiens
  misc_feature: GZ8MTXP01ASKBI.4.74.G08.1.454.CMB.2.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagcnggtatcagcaagaaaccagggaaacncccctaaagctcctgactctacgctgcgttctagtttacagagtggactcccccatcgaaggttcagcggcnggtggatcgtggcacagtactttcactctcaccatcagcagcctgcagcctggaggggttatttgactaacttattactgtactacaagtacttactacttcccgtgggtacgttcggaccaacgggacctaagggttacggaaattacgaaacgtactggtggcttgtccgaacctaac

SEQ ID NO: 342548 - DNA, 540 bp, Homo sapiens
  misc_feature: GZ8MTXP01BP7MO.4.74.G08.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaanctggatcagcaagaaaccgagggaaacnccccctaaagcctcctgatctacgctgcgtcttagtttacagagtggacgtccccatacaaggttcagcggcnggtgggatcgtaggcacagtactttcactctcaccatcagcagcctgcagcctagaggggtatttagctaacttattactgtactacaagtacttacctacgttcccgtaagggtacgttcgggacccgaaagggtaaccgaagggttacgaaacgttacaaacgacgtgtacggcttacggcttaacgtaac

SEQ ID NO: 342549 - DNA, 533 bp, Homo sapiens
  misc_feature: GZ8MTXP01BW1K2.4.74.G08.1.454.CMB.2.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatcgaaatgaggtaancnggatcagcagaaacaggaaacncccctaaagctccngatctacgctgcgtctagtttacagagtggacgtcccccatacaaggttcagcggcaaggtggatcgtggcacagtactttcactctacacatcagcagcctgcagctgaggggtattttgactaacttattctgtactaacgaatacttactacttacccgtggggtaccgttcgggaccgttaacgggaaccgaagggttacggaaattacgaaaacgtacgtgtgggacttacgccgaaccgtaacg

SEQ ID NO: 342550 - DNA, 547 bp, Homo sapiens
  misc_feature: GZ8MTXP01CDRW3.4.74.G08.1.454.CMB.2.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (418)..(418): a, c, t, g, unknown or other
  misc_feature (418)..(418): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggganaagtcaggacatccgaatgaggtaagctggtatcagcaagaaaccgagggaaacncccctaagctcctgatctacgctgcgttctagtttacagtagtggacgtcccccatcgaaggttcaggcgggactggtggatcgtgggacaactagtactttccactcctacaccatcgaagcacgcctgcagcctgagggtnttttgactaactttatactgtacttaacaagtacttactaccttaccggtgggtaccgttcgggaccaaggggtaacctaagggttaggaaacttacgaaacggtactggtcgcttacgcaaccttaag

SEQ ID NO: 342551 - DNA, 533 bp, Homo sapiens
  misc_feature: GZ8MTXP01CUIP9.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
tcagagcactgtagcacgaccggtgctcgatttagtagctctatcagggggcaggagtcagacccactcaggacacagcatggacatgagggtccccgctcagctccgtggggctcctgctgctctggctcccaggtgccagatgtgccatccagatggcccagtctccaggttacctgtctgcgtatgtcgganacagagtcaccatcacttgccgggnaagtcaggacatccgaaatgaggtaanctggtatcagcaagaaaccagggaaacncccctaaagctcctgatctacgctgctntagttacagtagtggacgtcccccatacgaaggttcaaggcggcnggtggatcgtggacacagtactttcactctacacatccagcagcctgcagctagaggggttattttgactaacttatactgtactaacatattaccacttccgtgggtacgttcggaccgaagggaaccgaagggttaacggaaacttacgaaacgtaacgtggtcgcttagtaaccaacgtaag

SEQ ID NO: 342552 - DNA, 545 bp, Homo sapiens
  misc_feature: GZ8MTXP01B0X0U.4.74.G08.1.454.CMB.2.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
  modified_base (530)..(530): a, c, t, g, unknown or other
  misc_feature (530)..(530): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccgaggttacctgtctgcgtatgtcgganacagagtcacatcacttgccggnaagtcaggacatccgaaatgaggtaagctggtatcagcaagaaaccagggaaacncccctaaagctcctgatctacgctgcgttctagtttacagtagtggactcccccagtcaaggttcaggcgcngtggatcgtggcactagtactttcactcctacacctatcgagcacgcctggcacgtctgtaggtattttgactaacgtttatactgtactaactagtaactttacctaccgttacccgtggggtaccgtttcgggaccgttaaagggtaccgaaggttacggaacttacgaaacgtacgtgacgnttcggcaacgttaac

SEQ ID NO: 342553 - DNA, 507 bp, Homo sapiens
  misc_feature: GZ8MTXP01DFQJB.4.74.G08.1.454.CMB.2.raw
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (343)..(343): a, c, t, g, unknown or other
  misc_feature (343)..(343): n is a, c, g, or t
  modified_base (503)..(503): a, c, t, g, unknown or other
  misc_feature (503)..(503): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcaccatcacttgccgggcaagtcaggacatccgaaatgaggtaanctggtatcagcaagaaaccagggaaancccctaaagctcctgatctacgctgcgttctagtttacagagtggacgtcccccatcaaggtcagcggnaaggtggatcgtggcacagtatttcactctacaccatcagcagcctgcagcctgaggggtattttgactaacttattactgtactaacaagtacttacacttaccgtggtacgttcggacaagggaccaaggttagaaattacaaagactgtggcttgcnctaa

SEQ ID NO: 342554 - DNA, 556 bp, Homo sapiens
  misc_feature: GZ8MTXP01B2PKC.4.74.G08.1.454.CMB.2.raw
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacataccgaaatgaggtaagctggtatcagacaagaaaccagggaaacncccctaaagctcngatctacgctgctctagtttacagagtgacgtcccccatcgaaggttcaggcggcaaggtggatctggacanagtatttcactctcacatcagcancctgcagctgagggtattttgacttaacttattaactgttactaactaagtatttaacctaccgtttacccgtggggtaccgttacgggacccgaaaggggtaccgtaagggttaaggaaacttaacgtaaaacgtaacgtggttacggcgttacgaaccttaacccgtaa

SEQ ID NO: 342555 - DNA, 507 bp, Homo sapiens
  misc_feature: GZ8MTXP01DHC6Z.4.74.G08.1.454.CMB.2.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (341)..(342): a, c, t, g, unknown or other
  misc_feature (341)..(342): n is a, c, g, or t
  modified_base (502)..(502): a, c, t, g, unknown or other
  misc_feature (502)..(502): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagatcaccatcacttgccgggcaagtcaggacatccgaaatgaggtaanctggtatcagacaagaaaccagggaaancccctaaagctcctgatctacgctgcgtctagtttacagagtggacgtcccccatcaaggttcagcgnngtgatctggcacagattcactctcaccatcagcagcctgcagcctgaggggtattttgactaacttattactgtctaacaagtattacaccttaccgtgggtacgttcggaccgaagggaccgaaggttaggaaattacgaaacgaactgtaggcttgcnctaac

SEQ ID NO: 342556 - DNA, 539 bp, Homo sapiens
  misc_feature: GZ8MTXP01DCUVU.4.74.G08.1.454.CMB.2.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (384)..(384): a, c, t, g, unknown or other
  misc_feature (384)..(384): n is a, c, g, or t
tcagagcactgtagcacgaccggtgctcgatttagtagctctatcagggggcaggagtcagacccactcaggacacagcatggacatgagggtcccgctcagctcctggggctcctgctgctctggctcccaggtgccagatgtgccatccagatggcccagtctcaggttacctgtctgcgtatgtcggagacagagtcaccatcacttgccgggcaagtcaggacatccgaaatgaggtaanctggtatcagcaagaaaccagggaaancccctaaagctctgatctacgctgcgttctagtttacagacgtgacgtccccatcaaggttcagcgggcaagtggatcgtggacacagtattcactctcacatcagcagtccngcacgctagtagggttatttcgacttaactttattactgtactaactaagtacttaactaccgttaccgtaacgggtacgttacgggacgaaacgggtaacgtaaggttaacgaaacttacgaaacgtacgtggtcgacgttacgtccaactaag

SEQ ID NO: 342557 - DNA, 555 bp, Homo sapiens
  misc_feature: GZ8MTXP01CPLTW.4.74.G08.1.454.CMB.2.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatcgaaatgaggtaancnggtatcagcaagaaaccagggaaacncccctaagctcctgatctacgctgcgttctagtttacagagtggacgtcccccatcgaaggttcagcggcgngtggatcgtggacacagtatttactactctcacactcagcagcctgcacgcctagtaggggtatttgtacctaactttacttactcgttactaactaaagtacttaactaccttaccgtaacgggtacgttacgggtaccgaacgggtaaaccgaaggttacggaaacgttacgaaacgaaccgtgtcggcgttacgaacgaacctaacg

SEQ ID NO: 342558 - DNA, 528 bp, Homo sapiens
  misc_feature: GZ8MTXP01DVJ28.4.74.G08.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (340)..(341): a, c, t, g, unknown or other
  misc_feature (340)..(341): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccggnaagtcaggacatccgaaatgaggtaanctggtancagacaagaaaccagggaaacncccctaaagctcctgactctacgctgcgttcttagttacagagtggactccccatcgaagtcagcgnngtgatctggcacagtacttcactctacaccatcaagcagcctagcacgcctgaggggtattttgactaacttattactgtactaacgaatacttactaccttaccgtgggtacgttcggaccgaaacgggaaccgtaagggttagaaacttacgaaaaccgtaatggtacgcttagcttaaccgtaa

SEQ ID NO: 342559 - DNA, 511 bp, Homo sapiens
  misc_feature: GZ8MTXP01AH90S.4.74.G08.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
  modified_base (496)..(496): a, c, t, g, unknown or other
  misc_feature (496)..(496): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatcgaaatgaggtaagctggtatcagcaagaaaccagggaaacncccctaaagctcctgatctacgctgcgtctagtttacagagtgacgtcccccatcaaggttcagcggcnggtgatcgtggcacagtattcactctcaccatcagcagcctagcagcctaggaggggtattttgctaaacttattactgtactaacaagtattaccacttacccgtgggacgttcgggacaaggggaccaaggttcggaaattacaaagactgnggcttgcaacgtaac

SEQ ID NO: 342560 - DNA, 538 bp, Homo sapiens
  misc_feature: GZ8MTXP01AC92X.4.74.G08.1.454.CMB.2.raw
  modified_base (343)..(343): a, c, t, g, unknown or other
  misc_feature (343)..(343): n is a, c, g, or t
  modified_base (426)..(426): a, c, t, g, unknown or other
  misc_feature (426)..(426): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgcgggcaagtcaggacatccgaaatgaggtaagctggtatcagcaagaaaccgagggaaacgcccctaaagctcctgatctacgctgcgtctaggtttacagagtgacgtcccccatcaaggttcagcggcngtggatcgtggcacagtatttcactctcacatcagcagctgcagcctagacggggttattttgccttaaactttattaccttntactaactaatacttaacctaccttccggtaaggtaccgttacggacgaaagggtaacgtaaaggttacgaaacacgaaacgtacgtggtcggacttacgaaccttaactaa

SEQ ID NO: 342561 - DNA, 603 bp, Homo sapiens
  misc_feature: GZ8MTXP01AHRE7.4.74.G08.1.454.CMB.2.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
tcagagcactgtagcacgaccggtgctcgatttagtagctctatcagggggcaggagtcagacccactcaggacacagcatggacatggacgggtccccgctcagctccgtggggctcctgctgctctggctcccaggtgccagatgtgccatccagatggcccagtctccaggttacctgtctgcgtatgtcgganacagagtcaccatcacgttggccggganaagtcaggacagtaccgaaatgaggtaagctggtatcagcaagaaaccgagggaaacncccctaagctctgactctacgctgcgttctagtttacagtagtggactccccatcgaaggtcagcggcnggtgatcgtggacacagtacttcactctacacatcagcacgtcctgcagccgttaggtaggggttatttttacggaccttaaactttattaccgtgttacctaaacgtaaagtacttaacctaaccgtttaccccggtaaggggtacccgtttaccgggaaccggaaacggggtaacccgtaaaggggttacgttaaaacttaccgaaaaccggtacgtcgggtaggccgttacgcccgttaaccttaacg

SEQ ID NO: 342562 - DNA, 520 bp, Homo sapiens
  misc_feature: GZ8MTXP01AKLSQ.4.74.G08.1.454.CMB.2.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
tcagagcactgtagcacgaccggtgctcgatttagtagctctatcgagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaaatgagtagctggtatcagcaagaaaccagggaaacncccctaagctcctgatctacgctgcgtctagttacagagtggatcccccatcaaggttcagcggcaagtggatcgtggcacgagtactttcactctacaccatcagcagcctgacagcctgagggtatttgactaacttntactntacttaacaagtattacacttaccgnggtacgttcggaccaaaggggacctaagggttacggaaacttacgaaacgtacgtggtacggtcttagccaacctaag

SEQ ID NO: 342563 - DNA, 504 bp, Homo sapiens
  misc_feature: GZ8MTXP01DJMQ6.4.74.G08.1.454.CMB.2.raw
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (498)..(498): a, c, t, g, unknown or other
  misc_feature (498)..(498): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaancccctaaagctcctgatctacgctgcgttctagtttacagagtggacgtcccccatcaaggttcagcggcngtgatctggcangatttcactctcacatcagcagccngcagcctgaggggtatttgactaacttnttactgtactaactaagtattacacttaccgtggtacgttcggaccgaagggaccaaggttaggaattacaaacgaactgtcgcttgcnctaacg

SEQ ID NO: 342564 - DNA, 532 bp, Homo sapiens
  misc_feature: GZ8MTXP01DF774.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaaatgaggtaagctggtatcagacaagaaaccagggaaacncccctaaagctcctgatctacgctgcgttctagtttacagagtgacgtcccccatcaaggttcagcggcaagtggatctggcacagtattcactctcacatcaagcagcctgtacgcctagacggttattttagcttaaactttattactgttactaactaaagtacttacctacttacccgtgggtaacgttcgggacgaacgggaccgtaaagggtgaaagttcgaaaacgtaactagtggctgctaacaattcg

SEQ ID NO: 342565 - DNA, 555 bp, Homo sapiens
  misc_feature: GZ8MTXP01ACXLG.4.74.G08.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcaccatcacttgccgggnaagtcaggacatcgaatgaggtanctggtatcagcaagaaaccaggaacncccctaagctctgactctacgctgcttctagttacagagtggacgtccccatcgaaggtcaggtcggcaaggtgatcgtggcacagtactttcacttctacacctatacgagtcacgccctgccgaggtccttaggacggggttattttcgaccttaactttattactgtactaaacaagtacttacctaccgttcccggtaagggtaccgttcgggaccgaaaggggtaaccgtaaagggttacgaaacttacgaaacgtacgtggtcgcttcgccaacgtaac

SEQ ID NO: 342566 - DNA, 576 bp, Homo sapiens
  misc_feature: GZ8MTXP01DS3QN.4.74.G08.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaaatgaggtaanctggtatcagacaagaaaccagggaaacncccctaaagctcctgactctacgctgcgttctagtttacaggtagtggactcccccatacgaaggttcaggcggcaaggtgggatcgtaggcactagtactttcactctacaccatacagccacgcctgacacgtccgtaggtacgggggttatttttacgacttaactttatacttagtacttaacaagtacttaacctaccttaccggtaagggtacgttccgggaaccgttaaacggggaaccgtaagggttacggaaattaaccgaaaacgtagtggtaggacttagtccaacgttaac

SEQ ID NO: 342567 - DNA, 571 bp, Homo sapiens
  misc_feature: GZ8MTXP01EJE1X.4.74.G08.1.454.CMB.2.raw
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagatcaccatcacttgccgggacaagtcaggacataccgaaatgaggtaanctggtatcagacaaggaaaccgagggaaacncccctaaagctacctgactcgtacgctgcttactagtttacagagtggacgtccccatcaaagggttcaggcggacnggtggatcgtggacaanagtactttacactctacaccatcgaagcacgccctggacagtacctaggaggggttatttgaaccttaactttactactgtacctaaagtaataacttacctacgttcccgtaaggggtaccgttacggaccggaaagggaccgtaaggttaacggaaacttacgaaaacgtacgtaaggcggacttacgccgaactcg

SEQ ID NO: 342568 - DNA, 543 bp, Homo sapiens
  misc_feature: GZ8MTXP01DHXM7.4.74.G08.1.454.CMB.2.raw
  modified_base (194)..(194): a, c, t, g, unknown or other
  misc_feature (194)..(194): n is a, c, g, or t
  modified_base (243)..(244): a, c, t, g, unknown or other
  misc_feature (243)..(244): n is a, c, g, or t
  modified_base (271)..(271): a, c, t, g, unknown or other
  misc_feature (271)..(271): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatcgaaatgagtannggtatcagacaagaaaccagggaaacncccctaagcctctgactctacgctgcgttctagtttacagtagtggacgttcccccatacgaaggttcaggcggacaaggtgatcgtggcacgagtacttcactctacaccatcagcagcctgcagccgtagaggggttattttcgactaactttattactgtactaacaagtattactacgttaccgtggggtaacgttcgggacgaaaggggaaccgaagggttacgaaacttaccgaaaacgtacgtggtcggtcttacgcaaccgtaa

SEQ ID NO: 342569 - DNA, 569 bp, Homo sapiens
  misc_feature: GZ8MTXP01DP981.4.74.G08.1.454.CMB.2.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacataccgaaatgaggtaagctggtatcagacaagaaaccgagggaaacnccccctaaagcctacctgactactacgctgccgttactagtttacagtagtggactacccccatacgaaggtcaggcgcnggtgatcgtggacanagtacttcactctacacatacagcagcctgccagcctagaggggttattttcggaccttaaactttattacctgtactaactaagtatttcgacctaccgttaacccggtggggttaccgttaccgggacgtaaacggggtaccgaaagggttcgaaaactaacgaaaacgtaacgtggtacggctaacgcctaacc

SEQ ID NO: 342570 - DNA, 535 bp, Homo sapiens
  misc_feature: GZ8MTXP01BF0DO.4.74.G08.1.454.CMB.2.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccgagggaaacncccctaaagctcctgatctacgctgcgtntagttacagtagtggacgtcccccatcgaaggttcaggtcggacnggtggatcgtggcacagtacttcactctcacatcagcagcctgcagctgagggtatttgactaacttattactgtactacaagtacttactaccttaccgtgggtcgttacgggaccgttaaagggaaccgtaagggttaacggaaacttacgaaaacgtactggtacggcttagccaacgtaacg

SEQ ID NO: 342571 - DNA, 631 bp, Homo sapiens
  misc_feature: GZ8MTXP01E5SIQ.4.74.G08.1.454.CMB.2.raw
  modified_base (275)..(275): a, c, t, g, unknown or other
  misc_feature (275)..(275): n is a, c, g, or t
  modified_base (397)..(397): a, c, t, g, unknown or other
  misc_feature (397)..(397): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagacaagaaaccagggaaacncccctaaagcctcctagatctacgctgcgttctagttacagagtggacgtcccccatacgaaaggttcaaggcggactaaggtgggatcgtggacacgagtactttccaactctacaccaanacacgcacgcgtagctacgtcgtaggtaggtttatttacgaaccttaaacttacttacgtacgttaactaaacgtaaacgttaaccttaaccgtaacccgtttaacccgggtaacggggtaaccggttaccgggaaaccggttaaacgggtaaaccggtaaaggttaacggttaaaacttaaaccgtaaaacggtacgttaacggtcggtacttaccgtaaccttaaccgtaag

SEQ ID NO: 342572 - DNA, 521 bp, Homo sapiens
  misc_feature: GZ8MTXP01A8TTD.4.74.G08.1.454.CMB.2.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccgggcaagtcaggacatcgaaatgagtanctggtancagcaagaaaccaggaaacncccctaaagctcctgatctagctgcgttctaagtttacagtagtcggacgtcccccaatacgaaggttcaggaccgggctaaggtggatcgtcgggacaacagtaactttcaactctacaccatcagcacgctgcagccgtagacggggttatttcgactaactttatactgtctaacagtattacncttaaccgnggtacgttcggacaaggacaagttagacttacgaactacgngtgcttgaacncgtn

SEQ ID NO: 342573 - DNA, 631 bp, Homo sapiens
  misc_feature: GZ8MTXP01CWROR.4.74.G08.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (396)..(396): a, c, t, g, unknown or other
  misc_feature (396)..(396): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctcaggttacctgtctgcgtatggtcgganacagagtcacatcacttgccgggnaagtcaggacatccgaaatggaaggtaagctggtatcagacaagaaaccgaggaaacncccctaaagctccngactctacgctgcgttctagtttacagtagtggactcccccatacgtaaggttcagcggacaaggtgggatcgtggacacagtactttcactctacacatcagcancctgacacgccgttagaggggttacttttagactaactttacttactgtactaaactaagtacttaaccgtaccgttaacccggttaacgggggtaacccgtttaccggggaaccggttaaaacgggggtaaacccgtaaaagggggttaacggttaaaaacgttaacccggaaaaaacgggttaaccgttaacggtaaggggtaactttacggaacccgttaaccctttaacgg

SEQ ID NO: 342574 - DNA, 666 bp, Homo sapiens
  misc_feature: GZ8MTXP01B5JOO.4.74.G08.1.454.CMB.2.raw
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
tcagagcactgtagcacgaccggtgctcgatttagtagctctatcagggggcaggagtcagacccactcaggacacagcatggacatgacgggtccccgctcagctcctggggctcctgctgctctggctcccaggtgccagatgtgccatccagatggcccagtctccaggttacctgtctgcgtatgtcggagacagatcacatcacgttcggccggganaagtcgaggacagtaccgaaatggaaggtaancgtaggtatcgagacaaacggaaaccgaagggaaacncccctaagcctcctagactcgtacgctgtcgttacttagttacgagtaggtcggactcccccatacgtaaggtcaggcgacnggtgatcgngacacgtagtacttcactctacacatcagacacgtccngcacgtccgtaggtacggggttatttttacgaaccttaaactttacttacgttacgttacttaaacgtaaacgttactttaacctaacccgtttacccggtaacggggttaaccggtttaccgggaaacccgttaaacggggtaaacccgtaaaggggttaaacgggttaaaaccttaaaccggtaaaaccggttaaccgttaagggttacggggtttacgacccgtaacccgttaagttttcccg

SEQ ID NO: 342575 - DNA, 546 bp, Homo sapiens
  misc_feature: GZ8MTXP01BAVUC.4.74.G08.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaanctggtatcagcagaaaccatggaaagcccctaagctcctgatctacgctgcgtctagtttacagagtggacgtccatcaaggttcaagcgnagtgatctggcacagtatttcactctcacatcagcagcctgcagcctgggtaggtattttcgcttaaaaacttcttactagtactaactaaagtactttaacctaaccgtttaacccgtacgggttacgttaccgggaccgaaacggggaaccaaaggggttacggaaaactaacgaaacgaacgtaggtagggaacttcgcgtaaccg

SEQ ID NO: 342576 - DNA, 523 bp, Homo sapiens
  misc_feature: GZ8MTXP01CPEUK.4.74.G08.1.454.CMB.2.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (334)..(334): a, c, t, g, unknown or other
  misc_feature (334)..(334): n is a, c, g, or t
  modified_base (414)..(414): a, c, t, g, unknown or other
  misc_feature (414)..(414): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctcaggttacctgtctgcgtatgtcggagacagagtcaccatcacttgccgggnaagtcaggacataccgaaatgagtaancngtancagcaagaaacaggaaacncccctaagctcctgatctacgctgcgtactagtttacagagtgactcccccatcaagtcagcgnaaggtgatctggacacagtatttcacttcacacatcagcagcctgcagcctggagggtattttgactaacttattacgtntactaacaagtacttaacacttacccgtggggtaaccgttcggaccgaacgggaaacctaagggttaacgaaacttacgaaagtaacgtgttaggcttagccaacgtaa

SEQ ID NO: 342577 - DNA, 545 bp, Homo sapiens
  misc_feature: GZ8MTXP01DLBN9.4.74.G08.1.454.CMB.2.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
tcagagcactgtagcacgaccggtgctcgatttagtagctctatcgagggggcaggagtcagacccactcaggacacagcatggacatgacgggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaaatgaggtaanctggtatcagcaagaaaccgaggaaacncccctaaagctcctgatctacgctgcgttactagtttacagagtggacgtcccccatcaaggttcaggcggacnggtgatcgtggacacgtagtactttcactactacaccatcacgcacgcctgccagtcctgtaggggtattttcgaactaactttattactgttactaacgaagtacttaaccgacctttacccgtgggtacgttcggaccgaaagggaccgtaagttaggaacttacgaaacgtactggtcgcttgtaacaacgtaa

SEQ ID NO: 342578 - DNA, 550 bp, Homo sapiens
  misc_feature: GZ8MTXP01B71V1.4.74.G08.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccggnaagtcaggacatcgaaatgagtagctggatcagcaagaaaccgagggaacncccctaaagcctcngatctacgctgcgtctagttacagagtgactcccccatcaggtcagcgcngtggatcgtggcagagtattcactctacacatcacgcacgcctgactacgccgtaggtaggggtattttacgacttaacttattactgtactacaagtacttacctaccgttaccgtgggtaccgttcggaccgttaaaggggtaacccaaggggttacgaaacgttaccgtaaacggtacgtcggttcggaccttaggtaacccgttaaccgtaacg

SEQ ID NO: 342579 - DNA, 534 bp, Homo sapiens
  misc_feature: GZ8MTXP01CAO5U.4.74.G08.1.454.CMB.2.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
tcagagcactgtagcacgaccggtgctcgatttagtagctctatcagggggcaggagtcagacccactcaggacacagcatggacatgagggtccccgctcagctcctggggctcctgctgctctggcctcccaggtgccagatgtgccatccagatggcccagtctccaggttacctgtctgcgtatgtcggagacagagtcaccatcacttgccgggnaagtcaggacataccgaaatgaggtaanctggtatcagacaagaaaccagggaaacncccctaaagctcctgactctacgctgcgttctagtttacagtagtggactcccccatcgaaggttcagcgcngtgatcgtggacactagtactttcactctacacatcagcagccngcagctagagggttatttgactaactttatactgtactaacaagtacttactacttccgtgggtacgttcgggaccgaaaggtaaccgagggttaaggaaacttacgaaacgtaagtggtaggcttagaaccgaactaacg

SEQ ID NO: 342580 - DNA, 505 bp, Homo sapiens
  misc_feature: GZ8MTXP01DPLFQ.4.74.G08.1.454.CMB.2.raw
  modified_base (247)..(247): a, c, t, g, unknown or other
  misc_feature (247)..(247): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaagcnggtatcagacaagaaaaccagggaaagcccctaaagctcctgatctacgctgcgttctagtttacagagtggagtcccccatcaaaggttcaagcgggangtgatcgngcanatattcactcacacatcagcancngcacgcgtgaggtatttatactaacttattactatactaactaataatactactaccgtaacggtacgttcgtacgaacggaacgaaggaagaagaacaaagaacgtaagngngctcgctaa

SEQ ID NO: 342581 - DNA, 613 bp, Homo sapiens
  misc_feature: GZ8MTXP01DQ2HQ.4.74.G08.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
tcagagcactgtagcacgaccggtgctcgatttagtagctctatcaggggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcacatcacttgccgggnaagtcaggacatacgaatgagtanctgtancagacaagaaaccgaggaacncccaagctcctgactctacgctgcgttactagtttacagtaggtggactcccccatacgaggtcaggacggactaagggtgaatcgtaggccacgtagttactttccacttcctacacctatccacgtcacgtccctagacctacggtccgttagggtacggggtttacttttacggaacctttaaactttacttacctacgttactaaacgtacttaaccttaaccgtacccgtttaccggtaagggtaaccgttaccgggaaccgaaacggggaccgtaaagggttaacgaaacttaccgaaaaggtacgtggtcggacttacggaaccttaacgtaacg

SEQ ID NO: 342582 - DNA, 518 bp, Homo sapiens
  misc_feature: GZ8MTXP01C5L5P.4.74.G08.1.454.CMB.2.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggcaagtcaggacatcgaaatgagtaagctggtatcagacagaaaccagggaaagcccctaagctcctgatctacgctgcgttntagtttacagagtggactcccccatcaaggtcagcggcngtgatcgtggacacagtacttcactctcacatcagcagcctgcagcctgtaggggtattttgactaacttattactgtactaactaagtatttaccactttacccgtgggtaccgttacgggaccgaaaggggaccaagggttaggaaacttagaaacgtacgtgtggacttgcaacgtc

SEQ ID NO: 342583 - DNA, 558 bp, Homo sapiens
  misc_feature: GZ8MTXP01E37TS.4.74.G08.1.454.CMB.2.raw
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctccgtggggctcctgctgctctggctcccaggtgccagatgtgccatccagatggcccagtctccaggttacctgtctgcgtatgtcggagacagatcaccatcacttgccggnaagtcaggacatccgaaatgaggtaagcnggtatcagcaagaaaccagggaaacncccctaaagcctacctgatctacgctgcgtctagtttacagagtgagtcccccatcaaggttcagacggcaagtgaatctggcacagtatttcactctcacagtcaagcaacggcctcgcgacgaccgtagacgggggttattttaggtacctaactttaacttacgttacgtactaactaagtaacttaactaccttaacccgtcggtacgttacggtaccgaacggaacgaacggttaggaagttacgaaacgaaccgtaagtcggacgacgcgaacgtaacc

SEQ ID NO: 342584 - DNA, 538 bp, Homo sapiens
  misc_feature: GZ8MTXP01C7MCV.4.74.G08.1.454.CMB.2.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
  modified_base (538)..(538): a, c, t, g, unknown or other
  misc_feature (538)..(538): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatcgaaatgagtanctgtatcagcaagaaaccagggaaacncccctaagcctctgactctacgctgtcgttatagtttacaggtagtggacgtcccccatacgaaggttcaggcggctaaggtgacttcgtggactaacgtagtactttcacttctacaccatcagccagcctgcagtcctgtagggttatttcgacttaacttatactgtactaanagtacttacaccgttacccgngggtaacgttcggacgaagggtaccaaggttacgaaacttacgaaacgtacttggcgcagtaaccaacgtn

SEQ ID NO: 342585 - DNA, 575 bp, Homo sapiens
  misc_feature: GZ8MTXP01EEMEV.4.74.G08.1.454.CMB.2.raw
  modified_base (219)..(219): a, c, t, g, unknown or other
  misc_feature (219)..(219): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatactgcggcagtnagacatacgaatagaggtaagactggtagtacacgacgaagaaaccgaaacgggaaacggacccctaacgacgtcctacgagtctaacgtctgtcgtccttaagtttactagagtggagtccactanaaggttacgngcggcaagtgggatctcggnacagtatttcactcttccacatcaagcacgcctgcgacgccttaggtagggtagttttactacaaccttttagttactgtacttaaccaaagtacttacctaaacgttcccgtacggggtcgtttacggccggaaacggggacaaacgggtaaggaaacttacttaaacggaactgtggtcagactaaccaagtttccg

SEQ ID NO: 342586 - DNA, 502 bp, Homo sapiens
  misc_feature: GZ8MTXP01BW220.4.74.G08.1.454.CMB.2.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
tcagagcactgtagcacgaccggtgctcgatttagtagctctatcaggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatcgaaatgaggtagctggtatcagcagaaaccagggaaacncccctaaagctcctgatctacgctgcgtctagtttacagagtggagtccccccatcaaggttcagcggcaagtgggatcgtggcacagactttcactctcacatcagcagcctgcagcctgaggggtatttgactaacttatactgtctacaagtcttacacttacccgtggacgttcggaccgaagggaccaaggttagaattacgaaacgacgtgtggcttgcaactaac

SEQ ID NO: 342587 - DNA, 555 bp, Homo sapiens
  misc_feature: GZ8MTXP01AGCU2.4.74.G08.1.454.CMB.2.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccgggcaagtcaggacataccgaaatgaggtaagctggtatcagcagaaaccagggaaacncccctaagctcctgatcacgctgcgttctagtttacagtagtggacgtcccccatcgaaggttcaggtcggacnggtgatctggcacagtacttcactctcacatcagcagctgcagcctgaggggtnttttagactaacgttattactgtactaacaagtacttactaccgttaccgtgggtaccgtttccgggaccgttaaacgggaaccgtaaagggttacgaaaacgttaccgaaaacggtaacgtcggtacgggcttacggaaccttaacgttaacg

SEQ ID NO: 342588 - DNA, 524 bp, Homo sapiens
  misc_feature: GZ8MTXP01DCMNT.4.74.G08.1.454.CMB.2.raw
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
  modified_base (494)..(494): a, c, t, g, unknown or other
  misc_feature (494)..(494): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtagctggtatcagacaagaaaccgaagggaaacgccccctaaagcctcctgactctacgctgcgttctagtttacaggagtggactcccccatacgaggtcagcggcnggtgatcgtggcacagtatttcactctacaccatcagcacgctgcagcctggtaggtattttgacttaattnttactgtactaactagtacttaccacttaccgcgggtaccgttcggaccgaagggaccgaaggttacgaaanacgaaacgactggtcgcttgccaacgtaac

SEQ ID NO: 342589 - DNA, 534 bp, Homo sapiens
  misc_feature: GZ8MTXP01CPU9Q.4.74.G08.1.454.CMB.2.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaanctggtatcagcaagaaaccagggaaacncccctaaagctcctgatctacgctgcgttctagtttacagagtggactcccccatcaaggttcagcggcngtggatcgtggcacagtactttcactctacaccatcagcagcctgcagcctggaggggtattttgactaactttattactgtactaactaagtacttactaccttcccgtggggtaccgttcggacgaaacgggtaaccagggttacggaaattacgaaaacgtagtgtggcttacggaaccaacgtaac

SEQ ID NO: 342590 - DNA, 568 bp, Homo sapiens
  misc_feature: GZ8MTXP01B77EH.4.74.G08.1.454.CMB.2.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgccgggnagtcaggacatccgaaatgaggtaagctggtatcagacaagaaaccgagggaaacncccctaagcctacctgactctacgctgcgttctagtttacagtagtggacgtcccccatcgaaggtcaggcgnaaggtgatcgtggcacagtacttcactctcaccatcagcagcctgcagtccgtaggagggttacttttagactttaaactttatttaccgtattacctaaactaagtactttacctacccttacccggttgggtaccgtttccgggaaccgaacggggtaaaccgtaaggttacggaaaacttacgaaaacgtacgtgtacgggcttacgaacgccgtaac

SEQ ID NO: 342591 - DNA, 578 bp, Homo sapiens
  misc_feature: GZ8MTXP01DC1B4.4.74.G08.1.454.CMB.2.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
  modified_base (412)..(412): a, c, t, g, unknown or other
  misc_feature (412)..(412): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtacgganacagagtcacatcacttgccggnaagtcaaggacataccgaaatggaggtaagctggtatcagacaagaaaccagggaaacncccctaaagcctctagactctacgctgtccttactagtttacaggtagtggacgtccccccattacaaggtttcaaggtccgggctaagggtgtactcgtagggccaacagtactttccaactctacacatacancagcctgcagtcctagaggggttatttgactaactttatactgtactaaactagtactttaacctccgttacccgtaagggaaccgtttcggaaccggaaagggtaaccgaaggttaacggttaaacacgtaaaacggtaactggtaacggccttagccaacgttc

SEQ ID NO: 342592 - DNA, 565 bp, Homo sapiens
  misc_feature: GZ8MTXP01EW1FU.4.74.G08.1.454.CMB.2.raw
  modified_base (219)..(219): a, c, t, g, unknown or other
  misc_feature (219)..(219): n is a, c, g, or t
tcagagcactgtagcacgaccggtgctcgatttagtagctctatcagggggcaggagtcagacccactcaggacacagcatggacatggagggtccccgctcagctcctggggctcctgctgctctggctcccaggtgccagatgtgccatccagatggcccagtctccaggttacctgtctgcgtatgtcggagacagagtcacatcacttgccgggnaagtcaggacatacgaaatgaggtaagctaggtatcgagacaaggaaaccgaagggaaacgacccctaagcctacctgactctacgctgcgttactagtttacagtaggtcggactcccccatacgaaggttcaggcgacgtggtgggatcgtggacagagtattcactctcacatcagcagctgcagtctggtaggtattttagacttaatttatacttgtactaactaagtacttacctaccttacccggtgggtaccgttcggaccgttaaacgggaaccgtaagggttaacggaaattaccgtaaaacgtacgtggtaggtcgttacgaacgaaccgtaacg

SEQ ID NO: 342593 - DNA, 526 bp, Homo sapiens
  misc_feature: GZ8MTXP01BOXSK.4.74.G08.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (401)..(401): a, c, t, g, unknown or other
  misc_feature (401)..(401): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacgatcacttgccgggnaagtcaggacatccgaaatgaggtaagctggtatcagcagaaaccagggaaacncccctaaagctcctgatctacgctgcgtctagtttacagagtggagtcccccatcaaggttcagcggcaagtggatctggcacgagtactttcactctcacatcagcagcctgcagccgtgaggggtntttgactaactttattactgtactaacaagtacttactaccttacccgtgggtacgttcggaccgaagggaccgtaaggttacggaaacttacgaaacgagtcgtacggcttacgcaacctaacg

SEQ ID NO: 342594 - DNA, 551 bp, Homo sapiens
  misc_feature: GZ8MTXP01EI2NH.4.74.G08.1.454.CMB.2.raw
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (340)..(341): a, c, t, g, unknown or other
  misc_feature (340)..(341): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatacgaaatggagtaanctggtatcagacaagaaaccagggaaacncccctaaagctccngatcacgctgcgttctagttacngagtggactccccatcgaaggtcagcgnngtggatcgtgcacgagtacttcacttctacacattcaacgctacgcctacgcgacgtacgtacgtaggggttagtttagtacttaactttaacttacttactactaactaagtaacttactactaccgtaacggtacggttacggtaccgaacggaacgtaacggttaacgaacgttaacgaaacgaagtaacgtgcgttcgcaactaac

SEQ ID NO: 342595 - DNA, 579 bp, Homo sapiens
  misc_feature: GZ8MTXP01DTSIJ.4.74.G08.1.454.CMB.2.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagatcaccatcacttgccgggnaagtcaggacatacgaaatgaggtaagctggtatcagacaagaaacaggaaacncccctaaagctctgactctacgctgcttactagttacagtagtcgacgtccccatcgaaggtcagcggcaaggtgactcgtaggacactagtactttcacttcctacaaccntacagcagtccctgcaagtccgtggtaacggggttattttacggaaccttaaactttattaaccgtgttaactaaacgtaattacttaacctaccgttacccgtaaggggtacgttcgggaaccgaaagggtaaacctaaggttaacggaaacttaccgaaacgtaacgtggtcggcttacgaaccttaacgttc

SEQ ID NO: 342596 - DNA, 549 bp, Homo sapiens
  misc_feature: GZ8MTXP01C7U0E.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcgganacagagtcaccatcacttgccgggnaagtcaggacatccgaaatgaggtaagctggtatcagacagaaaaccgaggggaaancccctaaagctcctagatctacgctgcgttatagtttacagagtgacgtcccccatcaggttcagcggcnggtgggactcgtggacacgtagatttcacttctaccaccattacaagcacgcctgactgcctggaggttatttgactaactttattactgtactaactagtacttactaccgttcccgtaagggtaccgttacggaccgaagggaacctaagggttacgaaattacgaaagtaacgtgtcgggcttcgaaccaaccgttaag

SEQ ID NO: 342597 - DNA, 516 bp, Homo sapiens
  misc_feature: GZ8MTXP01DGAIP.4.74.G08.1.454.CMB.2.raw
  modified_base (219)..(219): a, c, t, g, unknown or other
  misc_feature (219)..(219): n is a, c, g, or t
  modified_base (432)..(432): a, c, t, g, unknown or other
  misc_feature (432)..(432): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcagaaaccagggaaagcccctaaagctcctgatctacgctgcgttcagtttacagagtggagtcccccatcaaggttcagcgcaagtgatctggcacagatttcactctcacatcagcagcctgcagcctgaggggtattttgactaacttattactgtctaactaagtattaacncttaacctgggtaccgtttcggaccttaaagggacccaaagggttaggaaattacgaaacgaacgtgtggcttgccaacgtaac

SEQ ID NO: 342598 - DNA, 547 bp, Homo sapiens
  misc_feature: GZ8MTXP01D8XLC.4.74.G08.1.454.CMB.2.raw
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagagcactgtagcacgaccggtgctcgatttagtagctctatcagggggcaggagtcagacccactcaggacacagcatggacatggagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgagtaagctggtatcagacaaggaaacagggaaacncccctaaagctacctgactctacgctgcttatagtttacagtagtggactccccatacaaggtcagcgcngtgatctggacanagtatttcactctcacntcagcacgcctgaccagcctaggtacggtattttgactaactttatacctgttactaaacgtaatacttaactaccgttacccgtgggtacgttacggaccggttaaacgggaaccgtaagggttagaaacttacgaaacgtaactggtacggcttgaaccttaacgtaaccg

SEQ ID NO: 342599 - DNA, 691 bp, Homo sapiens
  misc_feature: GZ8MTXP01A851Q.4.74.G08.1.454.CMB.2.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtagtgtcgganacagacgtcacatctacgtggccggactaagtcgaaggacagtacgaaatggaaggtancgtggtatcgagacgaacgaaaccggaagggaaccacccctaagcctacgtagtactcgtacgcgtgtcgtttacttaggttacgaggtaggtggacctaccccagtacgtaaggtcagggacggtactgggtggtaactcggtacggacctatacgtttactttaccaccttacctaccaactacacgaacgcgtaccgtaccgtgacgtaccggtaccgttagggttaacggtttacgttttacggaacctttaaacgtttaacttaccgtacgttaactaaacgtaacgttaaccttaaccgttacccgttaccgggtaacggggtaacccggttacgggaaacccggttaacgggaaacgtaacgggttaacgttaaacgttaacggtaaacgtcggttaaggttcgggtacttaccgtaacgttcttaaccg

SEQ ID NO: 342600 - DNA, 553 bp, Homo sapiens
  misc_feature: GZ8MTXP01EB41B.4.74.G08.1.454.CMB.2.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (345)..(346): a, c, t, g, unknown or other
  misc_feature (345)..(346): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcaccatcacttgccgggcaagtcaggacatcgaaatgaggtaagctggatnagcaagaaaccagggaaacncccctaaagcctaccgtgactctacgctgtcgtcttagttacagtagtggactccccatcgaagttcagcgnngtggatcgtgacagatcttcactcgtcacatcacgcacgcctgccagtaccgtggtagggttacttttggacttaactttattactattactaactaagtacttactaccttaccggtcgggtccgttacgggacccgttaaaggggaaccctaagggttacggttaaacacgtaaacgtacgtgtaggcttcggaacaaccgtaag

SEQ ID NO: 342601 - DNA, 538 bp, Homo sapiens
  misc_feature: GZ8MTXP01BSCH6.4.74.G08.1.454.CMB.2.raw
  modified_base (220)..(220): a, c, t, g, unknown or other
  misc_feature (220)..(220): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (463)..(463): a, c, t, g, unknown or other
  misc_feature (463)..(463): n is a, c, g, or t
tcagagcactgtagcacgaccggtgctcgatttagtagctctatcaggggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagacaagaaaccagggaaacgcccctaaagctcctgatctacgctgcgttnttagtttacagtagtggacgtcccccatcaaggttcagcggcnggtgatcgtggcacagtactttcactctacacatcaagcagcctgcagcctgtacggggtattttacgactaaactttatacctgttactaacaagtacttacacgtttcccgngggtacgttccggacgaaacgggaccgtaaggttaggaaacttacgaaaacgtacgtgtcggcttagccgctaac

SEQ ID NO: 342602 - DNA, 589 bp, Homo sapiens
  misc_feature: GZ8MTXP01BICNL.4.74.G08.1.454.CMB.2.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
  modified_base (557)..(557): a, c, t, g, unknown or other
  misc_feature (557)..(557): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccagggaaacncccctaaagctacctgactctacgctgcgtctagttacagagtggacgtcccccatcgaaggttcaggcggcnggtggactcgtaggcacgagtacttttacactctacaccatcagcagccctgacacgtccgtagtaggggtattttacgactaactttattactgtactaactaagtactttaaccaccgtttaacccgtgggtaaccgtttacgggaccgaaacggggaaaccctaaaggggttaggaaaacttacggtaaaaccggacgttaacgggngggtaccttacggtaacccgaaccgttaaccg

SEQ ID NO: 342603 - DNA, 614 bp, Homo sapiens
  misc_feature: GZ8MTXP01EOAAA.4.74.G08.1.454.CMB.2.raw
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (421)..(421): a, c, t, g, unknown or other
  misc_feature (421)..(421): n is a, c, g, or t
  modified_base (614)..(614): a, c, t, g, unknown or other
  misc_feature (614)..(614): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgccgggnaagtnaggacatacgaaatgagtaagctgtatcagacaagaaacagggaaacncccaagctcngatctacgctgcgttacttagtttacgagagtggacgtaccccagtactaaaggttacacggacgggacaagggtgtaacgtcgagggtacctacgaagttactttaccaacttcctcaacctatacacggccaggcccncgacgtacgtacgtaggtaggtttactttagtaacttaacgtttatcgtagttactaaataacgttaacttaccgtaacccggttacgggcgggtaacgttaccgggaacgttaaacgggaaacgtaaacggttaaacggttaaaacgttacgtaaaacgtacgtaaggtcgaccgttacaaccgttaacgtn

SEQ ID NO: 342604 - DNA, 643 bp, Homo sapiens
  misc_feature: GZ8MTXP01D5Q4E.4.74.G08.1.454.CMB.2.raw
  modified_base (219)..(219): a, c, t, g, unknown or other
  misc_feature (219)..(219): n is a, c, g, or t
  modified_base (243)..(244): a, c, t, g, unknown or other
  misc_feature (243)..(244): n is a, c, g, or t
tcagagcactgtagcacgaccggtgctcgatttagtagctctatcagggggcaggagtcagacccactcaggacacagcatggacatgacgggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaatgaggtannggtatcagcaagaaaccgaggaaacgcccctaaagcctactgactctacgctggcgttattagtttacaggtagtggacgttacccccatacgaaggttccaggcccgggtataagggtgggtacttacgtgggacctaactaggttacttttccaacttcctaccaaccgtattaccaaacggccaaggccctacggacacgtaccgtacgtacggggttagttttacggttacttaactttaatttaacgttacgttacgttaactaaacgtaacttaactaaccgttacccgttaacgggtacggttacggtaccggttaaacggtaaccgaacggttaaggttaacgttaacgtaaacgtaacgtaacgtagtagttacgtaacgaaccgtaacg

SEQ ID NO: 342605 - DNA, 573 bp, Homo sapiens
  misc_feature: GZ8MTXP01AZJ4S.4.74.G08.1.454.CMB.2.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (388)..(388): a, c, t, g, unknown or other
  misc_feature (388)..(388): n is a, c, g, or t
tcagagcactgtagcacgaccggtgctcgatttagtagctctatcaggggcaggagtcagacccactcaggacacagcatggacatgaggtccccgctcagctcctggggctcctgctgctctggctcccaggtgccagatgtgccatccagatggcccagtctccaggttacctgtctgcgtatgtcggagacagagtcaccatnacttgccgggcaagtcaggacatccgaaatgaggtaanctggtatcagcaagaaaccacgggaaancccctaaagcctcctgactctacgntacgctctagtttacagagtggacgtcccccatnaaggttcagcgcgngtgggatctggactacagtaactttcctaactcctcaaccccntaccaagccagccctgcacgacccttaggacggggtagttttcactaactttattacctagttctaacctaaagtacttactaacctccttaacgggacgggttaccgtccggaaacgggaaacgaaccggttagggttaaacgttagaaacccaagtaacgtaggtcgaccttaacgcgtaacc

SEQ ID NO: 342606 - DNA, 552 bp, Homo sapiens
  misc_feature: GZ8MTXP01C7IQO.4.74.G08.1.454.CMB.2.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (335)..(336): a, c, t, g, unknown or other
  misc_feature (335)..(336): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (546)..(546): a, c, t, g, unknown or other
  misc_feature (546)..(546): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcattgccgggcaagtcaggacatcgaatgaggtaanctggtancagacaagaaaccagggaaacncccctaaagctctgactctacgctgcgttatagtttacagagtgactccccatcagtcagcgnngtgatcgnggcagtatntttcactcacacgtatacagcagtcccagacagacctaggtagggtttacttttcggaacttaactttattactgttacctaaagtaagtacttaaccgtaccgttaccccggtaaggggtaccgttccgggaaccgaaagggtaacccgagggttaacgaaacttacgaaagtacgtgacggcttcgaaccncgttaa

SEQ ID NO: 342607 - DNA, 544 bp, Homo sapiens
  misc_feature: GZ8MTXP01EUPDH.4.74.G08.1.454.CMB.2.raw
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaanctggtatcagacaagaaaccagggaaacncccctaaagctcctgatctacgctgcgtcttagtttacagagtggacgtcccccatcaaggttcaggcggcaaggttggatcgtggcacagtatttcacttctacacagtcaagcagcctgcagcctagagggtattttgacttaacttattacctgtactaactaagtattactacttacccgtgggtaacgttcggaccgttaaagggaccgtaaagggttaggaaacttacgaaaacgtacgtgtacggcgttagcttaaccgtaa

SEQ ID NO: 342608 - DNA, 552 bp, Homo sapiens
  misc_feature: GZ8MTXP01BIMUK.4.74.G08.1.454.CMB.2.raw
  modified_base (247)..(247): a, c, t, g, unknown or other
  misc_feature (247)..(247): n is a, c, g, or t
  modified_base (275)..(275): a, c, t, g, unknown or other
  misc_feature (275)..(275): n is a, c, g, or t
  modified_base (355)..(355): a, c, t, g, unknown or other
  misc_feature (355)..(355): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtagcnggtatcagacaagaaaccgagggaaacncccctaaagctcctgactctacgctgtccgtattagtttacagtacgtggacgtccccccatacgaaggttcagcggacnggtgatctggcacgagtacttcactctacacatacagcagcctgcacgtctagtagggtattttgacttaacgtttattactcgtactaaccgaatacttactacccttacggtcgggtaccttcggaccgttaaagggaacccaagggttacggaaacttacgaaacgtacgttggagtcttacgccgaactaacg

SEQ ID NO: 342609 - DNA, 648 bp, Homo sapiens
  misc_feature: GZ8MTXP01E1LI6.4.74.G08.1.454.CMB.2.raw
  modified_base (226)..(226): a, c, t, g, unknown or other
  misc_feature (226)..(226): n is a, c, g, or t
  modified_base (422)..(422): a, c, t, g, unknown or other
  misc_feature (422)..(422): n is a, c, g, or t
tcagagcactgtagcacgaccggtgctcgatttagtagctctatcagggggcaggagtcagacccactcaggacacagcatggacatgacggggtccccgctcagctccgtggggctcctgctgctctggctcccaggtgccagatgtgccatccagatggcccagtctccaggttacctgtctgcgtatggtcggagacagagtcaccatcacgttggccggganaagtcaggacataccgaaatgaggtaagcgtggtatcaagacaacggaaaaccgaaggggaaacaccccctaaagcctccgtgactctacgctgtccgttattaggtttacagtaggtacggacgtcccccatacgaaggttcacggcggcaagggtcgatcgtaggacacagtactttccacttcctacacctanacgacgacgacgtcctagaccgtacgtacgtaggtaacgggtttactttacgtaaccttaactttaacttacgtacgttaacttaaactaacgttaacttaaccgttaacccgttaccgggttaacgggtaaccggttaccgggaaccggttaaacgggaaccgtaaagggttaacgttaaacgttaacgaaacgtagtcggtagtacttacgtaacccgaacgtg

SEQ ID NO: 342610 - DNA, 538 bp, Homo sapiens
  misc_feature: GZ8MTXP01C0NKO.4.74.G08.1.454.CMB.2.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (520)..(520): a, c, t, g, unknown or other
  misc_feature (520)..(520): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctcaggttacctgtctgcgtatggtcgganacagagtcaccatcacttgccgggcaagtcaaggacatcgaatgaggtaancngtancagacaagaaaccagggaaacnccctaaagctactgatcgtacgctgcgttctagtttacaggtagtggacgtcccccatacgtaaggttcgagcggctaagtgggatcgtgggacacgagtacttcactctacacntcgagcanccngacagcgtagagggttatttgacttaatttattactgttactaaacagtacttacaccgtttaccgaagggtacgttcggacgaaaggtaaccgtaaggttagaaacacgtaaagacgtgnggcttacgaacttcgtaa

SEQ ID NO: 342611 - DNA, 586 bp, Homo sapiens
  misc_feature: GZ8MTXP01ENAUO.4.74.G08.1.454.CMB.2.raw
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
tcagagcactgtagcacgaccggtgctcgatttagtagctctatcagggggcaggagtcagacccactcaggacacagcatggacatgacgggtccccgctcagctcctggggctcctgctgctctggctcccaggtgccagatgtgccatccagatggcccagtctccaggttacctgtctgcgtatgtcggagacagagtcacatcacgttgccggganaagtcaggacatacgaaatgaggtancnggtancagacaagaaaccgaggaacncccctaagctccngactctacgcgtgcttataagttacaggtagtcggactcccccagtacgtaaggtcaggtcgactgggtgacttcgacggacacgtagtactttcgacttctacacatcgaagcacgcctgacacggtcctaggtagggttatttaccgaattaacctttattaccgtgttaacctaaacgaacttaacttaaccgtaccgtttaccggaagggttacccgttacgggaaccgaaaggtaaccgtaaaggttacggaaacttacgaaaccgtgttaaggcgtacagtccgttaacctg

SEQ ID NO: 342612 - DNA, 648 bp, Homo sapiens
  misc_feature: GZ8MTXP01ASSOI.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (340)..(340): a, c, t, g, unknown or other
  misc_feature (340)..(340): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaatgaggtanctgtatcagacaagaaacgaggaacncccctaagcctcctgactctacgctgcgtctagttacagagtcggactcccccatcgaaggtcagcggcnggtgacgtcgtggactacgtagtactttccacttcctacaccctatcacggacctagccctggcctaacggtcctagggtaaggggttactttttacgaaccttaaacttttactaaccgttcgttaaccttaaacgtaaacgtacctttaaaccgacccgttttaacccgggtcggggttaaccggtttcccgggaaaccggttaaacgggggtaaaccccgaaagggggttaaccgaaaacgttaacccgaaaacggtacccggttgggttccgggaccttaccggaacccgttaaacccgttaag

SEQ ID NO: 342613 - DNA, 500 bp, Homo sapiens
  misc_feature: GZ8MTXP02HGL1X.4.74.G08.1.454.CMB.2.raw
  modified_base (271)..(271): a, c, t, g, unknown or other
  misc_feature (271)..(271): n is a, c, g, or t
tcagagcactgtagcacgaccggtgctcgatttagtagctctatcaggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaancccctaagctcctgatctacgctgcgtctagtttacagagtggagtcccccatcaaggttcagcggcagtggatctggcacagatttcactctcaccatcagcagcctgcagcctgacggtattttgactaacttattactgtactacaagtattacacttaccctgggtacgttcggaccaagggaccaaggtaggaaatacgaaacgaactagtacggctgcactac

SEQ ID NO: 342614 - DNA, 479 bp, Homo sapiens
  misc_feature: GZ8MTXP02GMWTG.4.74.G08.1.454.CMB.2.raw
  modified_base (272)..(272): a, c, t, g, unknown or other
  misc_feature (272)..(272): n is a, c, g, or t
  modified_base (338)..(338): a, c, t, g, unknown or other
  misc_feature (338)..(338): n is a, c, g, or t
  modified_base (414)..(414): a, c, t, g, unknown or other
  misc_feature (414)..(414): n is a, c, g, or t
tcagagcactgtagcacgaccggtgctcgatttagtagctctatcaggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaancccctaagctcctgatctacgctgcgtctagtttacagagtgagtccccatcaaggttcagcggcngtggatctggcacagatttcactctcacatcagcagcctgcagcctgaggtattttgctaacttatactgtctaanaatatactactacgtggtacgtcgacgaaggacagtacgaatacaaacgtactgacgctcacaca

SEQ ID NO: 342615 - DNA, 531 bp, Homo sapiens
  misc_feature: GZ8MTXP02JNC7Q.4.74.G08.1.454.CMB.2.raw
  modified_base (219)..(219): a, c, t, g, unknown or other
  misc_feature (219)..(219): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccagggaaagcccctaagctcctgatctacgctgcgtctagtttacagagtggagtcccccatcaaggttcagcggcagtggatcgtggcacagatttcactctacaccatcagcagcctgcagcctgaggtatttgactaacttattactgtactacaagtacttacacttacccgtgggtaccgtttacggaccgaaacggggaacctaaagggtacggaaaacttacgaaaacggaacttacgtaggacttacggaccacctaac

SEQ ID NO: 342616 - DNA, 504 bp, Homo sapiens
  misc_feature: GZ8MTXP02GZ097.4.74.G08.1.454.CMB.2.raw
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaagcccctaagctcctgatctacgctgcgtctagtttacagagtggagtccccatcaaggttcagcggcagtgatctggcacagatttcactctcaccatcagcagcctgcagcctgaggtatttgactaacttatactgtactacaatattacacttaccctcgggtacgtttcggaccgtaaagggacctaaggtacggaaatacaaaacgaactagtcgactgaccactac

SEQ ID NO: 342617 - DNA, 550 bp, Homo sapiens
  misc_feature: GZ8MTXP02IF0TW.4.74.G08.1.454.CMB.2.raw
  modified_base (245)..(245): a, c, t, g, unknown or other
  misc_feature (245)..(245): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaanctgtatcagcaagaaaccagggaaacgcccctaagctcctgactctacgctgcgtctagttacagagtggagtccccatcaaggttcagcggcaggtgatcgtgcanagatttcactctacaccancagcacncncgcacgacgtagtaggttagtttagtacttaacttacttactacgtactaactaacgtaacttaactaaccgttaccgtacggtaccggttaccggtacggaaacggaacggtaacggtaacgtaaacgtaacgtaaacgtaacgtacgtacggtacgtacgacactacg

SEQ ID NO: 342618 - DNA, 511 bp, Homo sapiens
  misc_feature: GZ8MTXP02F17C7.4.74.G08.1.454.CMB.2.raw
  modified_base (274)..(274): a, c, t, g, unknown or other
  misc_feature (274)..(274): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaaatgaggtaagctggtatcagcaagaaaccagggaaancccctaagctcctgatctacgctgcgtctagtttacagagtggagtccccatcaaggttcagcggcagtggatcgtgcacagtatttcactctcaccatcagcagcctgcagcctagaggtatttgactaaacttattactgtactaacaaagtacttacacttacccgtgggaccgttcggaccaaagggaccaagggtacgaaatacgaaaagtaacgtgtacggctgacactac

SEQ ID NO: 342619 - DNA, 531 bp, Homo sapiens
  misc_feature: GZ8MTXP02G9BCC.4.74.G08.1.454.CMB.2.raw
  modified_base (378)..(378): a, c, t, g, unknown or other
  misc_feature (378)..(378): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaagctggtatcagcaagaaaccagggaaacgcccctaagctcctgatctacgctgcgtctagttacagagtggactcccccatcaaggttcagcggcaggtgatcgtggcacagtatttcactctcacatcagcancctgcagcctgaggtattttgactaacttattactgtactaactaagtacttaactacgttacccgtacgggtaccgttacggaccgtaaagggaaccgaagggtacgaaacgttacgaaaacgtacgtacggtaggacctcggaccactacg

SEQ ID NO: 342620 - DNA, 536 bp, Homo sapiens
  misc_feature: GZ8MTXP02GNTUU.4.74.G08.1.454.CMB.2.raw
  modified_base (194)..(194): a, c, t, g, unknown or other
  misc_feature (194)..(194): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccggcaagtcaggacatcgaatgagtaagctgtatcagcaagaaaccaggaaacncccctaagctccngactctacgctgcgtntagtttacagagtggacgtccccatcaaggttcagcggcngtgatcgtggacacagtatttcactctcaccatcagcacgcctgcagccgtgaggttattttgacttaactttattactgtactaacgtaagtacttaaccactttacccgtagggtaccggtttacggaccgtaaacgggacctaaacgggtacggaaaactacgaaaacgtacgtaggtacgactacgaccactacg

SEQ ID NO: 342621 - DNA, 499 bp, Homo sapiens
  misc_feature: GZ8MTXP02H1P9L.4.74.G08.1.454.CMB.2.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgccgggnaagtcaggacatccgaaatgaggtaanctggatcagcaagaaaccagggaaacncccctaaagctcctgactctacgctgcgtctagttacagagtggatccccatcaaggtcagcgcngtgatcgtgcacagtattcactctcaccatcagcagcctgcagcctgaggtattttgactaacttattactagtactacaagtattacacttacctacggtacgttcggacaaggaaccgaaggtagaaatacgaaaacgaactacgtaggctcgacaccta

SEQ ID NO: 342622 - DNA, 509 bp, Homo sapiens
  misc_feature: GZ8MTXP02HL39Z.4.74.G08.1.454.CMB.2.raw
  modified_base (271)..(271): a, c, t, g, unknown or other
  misc_feature (271)..(271): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggatcagcagaaaccagggaaancccctaagctcctgatctacgctgcgttctagtttacagagtggatccccatcaaggttcagcggcagtgatctggcacagtattcactctcaccatcagcagcctgcagcctgaggtattttgactaacttattactgtactaacaagtattaactacttaaccgtcggtacgttacggacctaagggaaccaaggtacgaaatacgaaaacgactacgtacggactcgacacctag

SEQ ID NO: 342623 - DNA, 527 bp, Homo sapiens
  misc_feature: GZ8MTXP02G7CO5.4.74.G08.1.454.CMB.2.raw
  modified_base (219)..(219): a, c, t, g, unknown or other
  misc_feature (219)..(219): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaaatgaggtaagctggtatcagcaagaaaccaggaaacgcccctaagctcctgatctacgctgcgtctagtttacagagtggagtcccccatcaagttcagcgcagtgatcgtgcacagatttcactctcaccatcagcagcctgcagcctgaggtattttgactaacttatactgtactaacaaagtattaactacttaccccgtagggtaccgttacggaccgaaagggaacccgtaaacgggtaaggaaaactaacgaaaacgaaacgtacgtaggctacgacaccaac

SEQ ID NO: 342624 - DNA, 557 bp, Homo sapiens
  misc_feature: GZ8MTXP02GGFMM.4.74.G08.1.454.CMB.2.raw
  modified_base (219)..(219): a, c, t, g, unknown or other
  misc_feature (219)..(219): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccgagggaaacgcccctaaagctcctgatctacgctgcgtctagtttacagagtggagtcccccatcaaggttcagcggcaggtgatcgtggcacagatttcactctcacntcancanctgcagcctgaggtnttttgactaacttatactgtactacaagtattactacttaaccgtgggtaccgttcgggaccgaaacggggtaacccgtaaaggggttaaacggaaaactttaccgaaaaacggtaaccgttagggttacggggaccttacggaccgaacccgtttaaccg

SEQ ID NO: 342625 - DNA, 532 bp, Homo sapiens
  misc_feature: GZ8MTXP02GV3CO.4.74.G08.1.454.CMB.2.raw
  modified_base (272)..(272): a, c, t, g, unknown or other
  misc_feature (272)..(272): n is a, c, g, or t
  modified_base (341)..(341): a, c, t, g, unknown or other
  misc_feature (341)..(341): n is a, c, g, or t
  modified_base (396)..(396): a, c, t, g, unknown or other
  misc_feature (396)..(396): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaancccctaagctcctgatctacgctgcgtctagtttacagagtggagtcccccatcaaaggttcagcggcnggtgatcgtggcacagatttcactctcaccatcaagcagcctgcagcctgaggtnttttgctaacttattactgtactacaagtacttactacgttaaccctgggtacgttcggaccgaacgggtaaccgaacgggttaggaaaacttacgaaaacggtaaccgtaggttcggactacggaccacctaacg

SEQ ID NO: 342626 - DNA, 540 bp, Homo sapiens
  misc_feature: GZ8MTXP02HIQMP.4.74.G08.1.454.CMB.2.raw
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccagggaacncccctaagctcctgatctacgctgcgtctagtttacagagtggatcccccatcaagttcagcggcnggtggatcgtggacacgagtacttcactctcaccatcagcagcctgcacgcctgtagtattttagactaactttattactagtactaacgtaacgtaacttactacgttacccgtacggggtaccgttcggaccgtaacggggaaccgaagggtacgaaaactacgaaaacgtaacgtacggtcggtactcgaccactacg

SEQ ID NO: 342627 - DNA, 504 bp, Homo sapiens
  misc_feature: GZ8MTXP02INYFF.4.74.G08.1.454.CMB.2.raw
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgttctagtttacagagtggacgtccccatcaaggttcagcggcngtgatctgcacagtattcactctcacatcancagcctagcagcctagaggtattttgctaacttattactgtactacaagtatacacttaccgtcggtacgttcggaccaacgggaaccgaaggtacggaaatacgaaaacgtactagtacgctcgacactac

SEQ ID NO: 342628 - DNA, 561 bp, Homo sapiens
  misc_feature: GZ8MTXP02IJ3WV.4.74.G08.1.454.CMB.2.raw
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaanctggtatcagcaagaaaccagggaaacgcccctaagctcctgatctacgctgcgtctagtttacagagtggactccccatcaagttcagcgnagtgatcgngcanagtnttcactctcacatcagcagcctgcagccgtagtaggtattttgacttaacgtttattactgtactaactaaagtactttaactacgtttacccgttagggtaccgtttaccgggaccgtaaaaggggaaccctaaaggggtaacgggaaaacttaccgaaaaacggtaacgttacggtacggtacgtacggtaccaacccgtaacg

SEQ ID NO: 342629 - DNA, 512 bp, Homo sapiens
  misc_feature: GZ8MTXP02HRHVV.4.74.G08.1.454.CMB.2.raw
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaancccctaagctcctgatctacgctgcgttctagtttacagagtggatcccccatcaaggttcaggcggcaggtggatcgtggcaacagtatttcactctcaccatcagcagcctgcagcctgagtattttgacttaattattactgtactaacaagtattactacttaccgtacgggtacgttcggacgaacggaaccgaggtacgaactaacaaacgacgtagtacgcgtacgcactac

SEQ ID NO: 342630 - DNA, 518 bp, Homo sapiens
  misc_feature: GZ8MTXP02FTF6D.4.74.G08.1.454.CMB.2.raw
  modified_base (194)..(194): a, c, t, g, unknown or other
  misc_feature (194)..(194): n is a, c, g, or t
  modified_base (340)..(340): a, c, t, g, unknown or other
  misc_feature (340)..(340): n is a, c, g, or t
tcagagcactgtagcacgaccggtgctcgatttagtagctctatcagggggcaggagtcagacccactcacgacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcagaaaccagggaaagcccctaagctcctgatctacgctgcgtctagtttacagagtggagtcccccatcaaggttcagcggcngtgatcgtgcacagatttcactctcacatcagcagcctgcagcctgaggtatttgactaacttattactgtactactaaagtacttaacacttacccgtaggggtaccgtttcgggacctaaagggggaccctaaagggtaaggaaatacgaaaacgtaactgtacggctgacaccta

SEQ ID NO: 342631 - DNA, 728 bp, Homo sapiens
  misc_feature: GZ8MTXP02G3831.4.74.G08.1.454.CMB.2.raw
  modified_base (194)..(194): a, c, t, g, unknown or other
  misc_feature (194)..(194): n is a, c, g, or t
  modified_base (462)..(462): a, c, t, g, unknown or other
  misc_feature (462)..(462): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagatccacatcacgttcggccgggacaagtcaggacagtaccgaaaatggaaggtaagcgtaggtatcgaagacaaacggaaaccgaaggaaaccacccctaagcctacgtagactaccgtacgtctcggtacgtttacgttaagtttaccgaggtacggtacggtacgtacccccctaagtaccgtaagggttcgacgggtcggacgtagggtcgaacttccggtacgactaacgtacgttactttaccacttcccacaccctanacgacgccgtacgtccgagaccgtacgtacgttaggttaacgtttactttaacgtaacttttaaacgtttaacgttacgttacgttaaaccgttaaacgttaacgtttaacccgtttaacccgtacccgggtttaaccggggttaaccggggtaacccggttaaaccgggaaaccgggtaaaacggtaaacggtaaacgggtaaaccgtaaaacgttaaccggtaaacggtacgttcgggtacctacgtaccgtaccttacgtacg

SEQ ID NO: 342632 - DNA, 529 bp, Homo sapiens
  misc_feature: GZ8MTXP02I8F6C.4.74.G08.1.454.CMB.2.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (338)..(338): a, c, t, g, unknown or other
  misc_feature (338)..(338): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcaagaaaccagggaaacncccctaagctcctgatctacgctgcgtctagtttacagagtggatccccatcaagttcagcgcngtgatcgtgcacagtatttcactctcacatcagcagcctgcagcctgaggtattttgactaatttacttactgtactaactaagtattaacactttacccgtgggtaccgtttccgggaccgtaaacgggaccgtaaagggtacgaaaactaacgaaaacgtaacgtaggtacggactacggaccactacg

SEQ ID NO: 342633 - DNA, 505 bp, Homo sapiens
  misc_feature: GZ8MTXP02J2R3S.4.74.G08.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccggnaagtcaggacatccgaatgaggtanctggtancagcagaaccaggaacnccctaagctcngatctacgctgcgtctagttacagagtggactccccatcaaggtcaggcggcngtggactcgtggcacagtactttcactctacaccatcagcacgctagcacgcctaggacggttntttgactaactttattacngttacaactagtattactacttacgtcggacgttcggacgaaggaccaggtacgaactacaacgtaactcgtacggacctcgactactacg

SEQ ID NO: 342634 - DNA, 531 bp, Homo sapiens
  misc_feature: GZ8MTXP02IDVCO.4.74.G08.1.454.CMB.2.raw
  modified_base (194)..(194): a, c, t, g, unknown or other
  misc_feature (194)..(194): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatacgaaatgagtagctggatcagcagaaaccaggaaacncccctaagctcngatctacgctgcgtcttagttacagagtggactcccccatcaaggtcagcggnaggtgatcgtgcacagtacttcactctacaccatcagcagcctgcacgcctgtaggtatttttgactaactttattacttagtactaacaacgtacttaactacttacccgtacgggtacgttaccggaccgtaaacgggaccgtaaggtacggtaaactacgaaaacgacgtacggtcgacgtacgactacctacg

SEQ ID NO: 342635 - DNA, 492 bp, Homo sapiens
  misc_feature: GZ8MTXP02GEODH.4.74.G08.1.454.CMB.2.raw
  modified_base (340)..(340): a, c, t, g, unknown or other
  misc_feature (340)..(340): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggacacagagtcaccatcacttgccgggcaagtcaggacatccgaaatgaggtaagctggtatcagcaagaaaccagggaaagcccctaagctcctgatctacgctgcgtctagtttacagagtggagtcccccatcaaggttcagcgcngtgatctggcacagatttcactctcacatcagcagcctgcagcctgacggtatttgactaacttatactgtactacaagattacacttacctaggacgttcggcgaaggaccgaagtacggaaatacaaaacgactgtacggactgcaccta

SEQ ID NO: 342636 - DNA, 513 bp, Homo sapiens
  misc_feature: GZ8MTXP02HRBB0.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaaatgaggtaagctggtatcagcaagaaaccagggaaancccctaagctcctgatctacgctgcgtactagtttacagtagtggagtcccccatcaaggttcagcgcngtggatcgtgcacagtacttcactctcacatcagcagcctgcagcctgagtattttagctaacttattactgtactacaagtattacacttacccgtcggtacgttcggacgaaacgggacgaacggtacggaaatacgaaaacgtacgtagtacggactacgactactac

SEQ ID NO: 342637 - DNA, 485 bp, Homo sapiens
  misc_feature: GZ8MTXP02HMC6Q.4.74.G08.1.454.CMB.2.raw
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (412)..(412): a, c, t, g, unknown or other
  misc_feature (412)..(412): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgagtaagctgatcagcagaaaccaggaaagcccctaagctcctgatctacgctgctctagtttacagtagtgagtcccccatcaaggttcagcgcngtggatctggcacagtattcactctcacatcancagcctgcagcctgaggtattttgctaacttattactgtactaanaagattacacttacctggacgttcggacaagggaccaaggacgaaatacaaacgacagtcgactcgacaccta

SEQ ID NO: 342638 - DNA, 589 bp, Homo sapiens
  misc_feature: GZ8MTXP02IAFLA.4.74.G08.1.454.CMB.2.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttggccgggnaagtcaggacatccgaaatgaggtagctgancagacaagaaaccgaggaaccgaccctaagcctctagactctacgctgtcgttacttagttacgagtaggtcggacgtaccccagtacgtaaggtcaggcggactaggtggatcgtgacacgtagtacttccactctacacatcagcacgcctgcacgcctaggtagtttatttcgaactttaacttattacgtagtaactaacgtaagttactttaaccgtacccgtttacccggtaggggtaccgtttccggaaaccgtaaacggggtaaccgtaaagggtaacggtaaaactaaccggaaaacgtacgtaggttacggactacgactaacctacg

SEQ ID NO: 342639 - DNA, 506 bp, Homo sapiens
  misc_feature: GZ8MTXP02IKIW2.4.74.G08.1.454.CMB.2.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccaggaaancccctaagctccngatctacgctgctctagttacagagtggagtcccccatcaaggttcagcggcnggtggatcgtggcacagtatttcactctcaccatcagcagcctgcagcctgaggtattttgactaacttattactgtactaacaagtattacacttacccgtaggacgttcggaccaagggaccgaaggtacgaaatacgaaaacgacgtagtacgacgtcgactacac

SEQ ID NO: 342640 - DNA, 652 bp, Homo sapiens
  misc_feature: GZ8MTXP02GPUBF.4.74.G08.1.454.CMB.2.raw
  modified_base (279)..(279): a, c, t, g, unknown or other
  misc_feature (279)..(279): n is a, c, g, or t
  modified_base (346)..(347): a, c, t, g, unknown or other
  misc_feature (346)..(347): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacgttgccgggcaagtcaggacataccgaaatggaggtaagctaggtatcagacaagaaaccagggaaacncccctaagctcctgactcacgctgcgttactagttacagagtggactccccatcgaaggtcaggcgnnggtgatcgtgcaacgtagtactttacacttcctacaacctatcgaacgccagccctaggacctacggtcccgttaggtaaggtttatttttacggactttaaactttacttaaccgtttagttaacctaacgtaaaacgttacctttaaccgtaaaccccgttttacccgggtacggggttacccggtttaccgggaacccggtaaaacgggggtaacccgtaaaaggggttaaacggtaaaacttaaaccggaaaacggttaaccgttaggttaacgggtcctaacggaccctaaaccgttacg

SEQ ID NO: 342641 - DNA, 523 bp, Homo sapiens
  misc_feature: GZ8MTXP02JRJTF.4.74.G08.1.454.CMB.2.raw
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (340)..(340): a, c, t, g, unknown or other
  misc_feature (340)..(340): n is a, c, g, or t
  modified_base (429)..(429): a, c, t, g, unknown or other
  misc_feature (429)..(429): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagatcaccatcacttgccgggnaagtcaggacatccgaaatgaggtaagctggtatcagcaagaaaccagggaaacncccctaagctcctgatctacgctgcgtctagttacagtagtggatcccccatcgaagttcagcggcngtggatcgtggacacagtatttcactctcaccatcagcacgcctgactcgcctaggtacggtatttgactaactttattactgtactanaagtattactacgttacctcgggtacgttcggaccgaaagggacctaaggtacgaaactaacgaaacgtactacggtacggctcggaccactac

SEQ ID NO: 342642 - DNA, 538 bp, Homo sapiens
  misc_feature: GZ8MTXP02F6N9L.4.74.G08.1.454.CMB.2.raw
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaanctggtatcagcaagaaaccgagggaaacgcccctaagcctcctgatctacgctgcgtctagtttacagagtgagtccccatcaaggtcagcggcnggtgatcgtggcaacgagtatttcacttctacacatcacgcagcctgacagcctgaggtattttgacttaaactttattacctgtactaactaagtattaacctacttacccggtacggtaccgttacggaccgaaacgggaccgtaaaggtaacggaaactacgaaaacgtacgtacgtacggctacgactactacg

SEQ ID NO: 342643 - DNA, 516 bp, Homo sapiens
  misc_feature: GZ8MTXP02GT3ZR.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (341)..(341): a, c, t, g, unknown or other
  misc_feature (341)..(341): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaaatgaggtaagctggtatcagcaagaaaccagggaaagcccctaaagctcctgatctacgctgcgtctagtttacagagtggagtcccccatcaagttcagcggcngtgatctggcacagatttcactctcaccatcagcagcctagcagcctgaggtacttttgactaaacttattactgtactaacaaagtattaacgacttacccgtgggaccgtttcggaccgaaagggaccgaaggtacggaaataccgaaaagactagtcggactcgacactaac

SEQ ID NO: 342644 - DNA, 524 bp, Homo sapiens
  misc_feature: GZ8MTXP02GWA6C.4.74.G08.1.454.CMB.2.raw
  modified_base (512)..(512): a, c, t, g, unknown or other
  misc_feature (512)..(512): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacgcccctaaagcctcctgactctacgctgcgttctagtttacagagtggactcccccatcaaggttcaggcggcaggtggatcgtgcacagtatttcactctcaccatcagcagcctgcagcctgaggtatttgactaacttattactgtactaacaagtattacacttaccgtaggtaccgttcgaccgaaacgggaccgaaaggtacggaaactaacgaaaacgtaactaggtacggntacgacaaccta

SEQ ID NO: 342645 - DNA, 486 bp, Homo sapiens
  misc_feature: GZ8MTXP02GMJ9Y.4.74.G08.1.454.CMB.2.raw
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgccggnaagtcaggacatccgaaatgaggtaagctggtatcagcagaaaccaggaaagcccctaagctcctgatctacgctgcgtctagtttacagagtgagtccccatcaagttcagcgcngtgatctggcacagatttcactctcacatcagcagctgcagcctgaggtattttgactaacttattactgtactacaagtattacacttacctggacgttcggacaagggaccaaggtagaagtacaaacgaactagtacgctacgacactac

SEQ ID NO: 342646 - DNA, 536 bp, Homo sapiens
  misc_feature: GZ8MTXP02JEDBQ.4.74.G08.1.454.CMB.2.raw
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgcaatccagatggcccagtctccaggttacctgtctgcgtatgtcggagacagagtcaccatcacttgccgggnaagtcaggacatccgaaatgaggtaagctggtancagcaagaaaccagggaaacncccctaagctcctgactctacgctgcgtctagttacagagtgactccccatcaagttcagcggcnggtgatcgtgacacagtatttcactctacacatcancaagcctgcacgccgtggtaggtattttcgactaacttagttactgtactaanaacgtacttaaccacttaccgtacggggtaccgttacggaaccgtaaacggggaccgtaaagggtacgaaaataccgaaaagactaggtacggctacggaccactacg

SEQ ID NO: 342647 - DNA, 535 bp, Homo sapiens
  misc_feature: GZ8MTXP02GVDJY.4.74.G08.1.454.CMB.2.raw
  modified_base (349)..(349): a, c, t, g, unknown or other
  misc_feature (349)..(349): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacataccgaaatgaggtaagctggtatcagcaagaaaccgagggaaacgcccctaaagctcctagatctacgctgcgtactagtttacagtagtggagtcccccatcaaggttcaggcggcnggtgatcgtggcacagtactttcacttctacacatcagcagcctgcagctgtagtntttgactaatttattactntactactaaagtacttacaccgtttacccgtagggtacccgttacggaccgaaaggggtaccaaacgggtaagaaactacgaaaagtaactggtacgtactcgaccactac

SEQ ID NO: 342648 - DNA, 490 bp, Homo sapiens
  misc_feature: GZ8MTXP02FHT9G.4.74.G08.1.454.CMB.2.raw
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccaggaaagcccctaagctcctgatctacgctgcgtctagtttacagagtggatcccccatcaagtcagcggcagtggatctgcacagatttcactctcaccatcagcagcctgcagctgaggatttgctaacttattactgtactaacaagattacacttaccctgggtacgttcggacaaacgggaccgaaaggtgaaaagtacaaacgaactagtggctgacaca

SEQ ID NO: 342649 - DNA, 507 bp, Homo sapiens
  misc_feature: GZ8MTXP02GJ5JI.4.74.G08.1.454.CMB.2.raw
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaagcccctaagctcctgatctacgctgcgtctagtttacagagtggagtcccccatcaaggttcagcggcagtggatcgtggcacagatttcactctcaccatcagcagcctgcagcctgacggtattttgactaaacttattactgtactacaagattaacacttaccgtgggacgttcggacctaagggaccaacggtagaaaatacgaaaacgactagtacggctacgcactac

SEQ ID NO: 342650 - DNA, 495 bp, Homo sapiens
  misc_feature: GZ8MTXP02HRILL.4.74.G08.1.454.CMB.2.raw
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaagctggtatcagcagaaaccaggaaagcccctaagctcctgatctacgctgcgtctagtttacagagtggactccccatcaagttcagcggcngtgatctggcacagnttcactctcacatcagcagcctgcagcctgaggtattttgctaacttattactgtactacagattacacttacctcggacgttcggacctaaagggaccaaggtacggaaatacgaaaacgtaactagtcggactcgactacta

SEQ ID NO: 342651 - DNA, 512 bp, Homo sapiens
  misc_feature: GZ8MTXP02GNTH1.4.74.G08.1.454.CMB.2.raw
  modified_base (423)..(423): a, c, t, g, unknown or other
  misc_feature (423)..(423): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaacgcccctaagctcctgatctacgctgcgtctagtttacagagtggatccccatcaaggttcagcggcagtgggatcgtggacacgagtactttcactctcaccatcagcagcctgcagcctgaggtatttgactaacttattactgtactanaagtattacacttacccgtggtacgttcggaccgtaacgggacctaaggtacgaaactacgaaaacgacgtagtcggctcgaccactac

SEQ ID NO: 342652 - DNA, 509 bp, Homo sapiens
  misc_feature: GZ8MTXP02H8QT0.4.74.G08.1.454.CMB.2.raw
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagagcactgtagcacgaccggtgctcgatttagtagctctatcagggggcaggagtcagacccactcaggacacagcatggacatgagggtcccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaacgcccctaagctcctgatctacgctgcgtctagttacagagtggagtcccccatcaagttcagcggcngtggatctgcacngattcactctcacatcagcagccctgcagcctggacgtattttgactaacttattactgtactacgaatacttacacttaccgtcgggtacgttcggaccgtaaagggaccgaaggtacggaactacgaaaacgtaactagtacggactcgacactac

SEQ ID NO: 342653 - DNA, 515 bp, Homo sapiens
  misc_feature: GZ8MTXP02HW35E.4.74.G08.1.454.CMB.2.raw
  modified_base (272)..(272): a, c, t, g, unknown or other
  misc_feature (272)..(272): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatacgaatgaggtaagctggtatcagcagaaaccagggaaacncccctaagctcctgatctacgctgcgtctagtttacagagtggacgtccccatcgaagttcaggcggcaggtggatcgtgcacagtactttcactctcacatacagcagctgcagcctgagtattttgactaacttattactagtactacaatacttaactacttaccgtacggtacgttacggacgaacgggaaccaagtacgaaatacaaaacgtaactacggtacgactacgactactac

SEQ ID NO: 342654 - DNA, 571 bp, Homo sapiens
  misc_feature: GZ8MTXP02G3R6P.4.74.G08.1.454.CMB.2.raw
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgaggtaanctggtancagcaagaaaccagggaaacncccctaaagcctcctagactctacgctgcgtctaagtttacagtagtggagtcccccatcaaaggttcaaggcgacagtgggatcgtggcaacagtatttcactctcacatcagccagccctacgcacgaccgtagtaggtagtttacgtacttaaacctttaaatttaacttacgttacttaacctaaagtaacttaactaacttaacccgttacggtacggttacggtaccgaacggaaacgaaacggtaaggaaacgtaacgaaaacgaaacgtacgtagacgtacgacactaac

SEQ ID NO: 342655 - DNA, 512 bp, Homo sapiens
  misc_feature: GZ8MTXP02IEKUB.4.74.G08.1.454.CMB.2.raw
  modified_base (252)..(252): a, c, t, g, unknown or other
  misc_feature (252)..(252): n is a, c, g, or t
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggccccagtctccaggttacctgtctgcgtatgtcggagacagagtcaccatcacttgccgggcaagtcaggacatacgaaatgagtaagctggancagcagaaaccaggaaacgcccctaagctctgatctacgctgcgtctagtttacagagtggactcccccatcaaggtcatcggcaggtgatcgtggcaacgagtatttcactctacaccatcagcagccncgcagcctgtaggtattttgactaactttattactgtactanaagtattacacttaccgtgggtacgttcggacgaaacggacgtaacggtaggaaactacgaaaacgtaagtgtacggctcgacactac

SEQ ID NO: 342656 - DNA, 597 bp, Homo sapiens
  misc_feature: GZ8MTXP02H7IRF.4.74.G08.1.454.CMB.2.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccggganaagtcaggacataccgaaatggaggtagctggtancagcaagaaaccagggaaacncccctaagcctctgactctacgctgcttcttagttacgaggtaggtacggacgtcccccagtacgaaggttcgacggcggctaggtcggactcgtaggaccaacgtagttactttccactcctaccaactatcacgcacgccctgacacgtccgtaggtagttacttttacgaccttaacgttacttacgtcgtaactaacgtaaagtacttacctaaccgttacccggtacggggtacccgttacgggaccgaaacgggaaccgtaaggtaacggtaaaactacgaaaacgtacgtggtacggactaccgactactacg

SEQ ID NO: 342657 - DNA, 521 bp, Homo sapiens
  misc_feature: GZ8MTXP02HNHJ5.4.74.G08.1.454.CMB.2.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggnaagtcaggacatcgaaatgagtagctggatcagcagaaaccagggaaacncccctaaagctcctgatctacgctgcgttctagtttacagagtggacgtccccatcaaggttcagcggcaggtggatcgtggacacagtactttcactctcaccatcagcacgcctgcagcctgaggtattttgactaacttattactgtactaactaagtattactacgttacccgtcgggtaccgttcggaccgaaacgggaccgaagggtacgaaactacgaaaacgtacgtgtacgactcgactactac

SEQ ID NO: 342658 - DNA, 544 bp, Homo sapiens
  misc_feature: GZ8MTXP02GGPC4.4.74.G08.1.454.CMB.2.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (334)..(335): a, c, t, g, unknown or other
  misc_feature (334)..(335): n is a, c, g, or t
  modified_base (419)..(419): a, c, t, g, unknown or other
  misc_feature (419)..(419): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatcgaaatgagtagntggtancagcaagaaaccgagggaaacnccctaagctcngatctacgctgcgtntagtttacagagtggactccccatcaaggtcagcgnngtgatcgtgcacagtatttcacttctcaccatcagcacgcctagcacgcctggaaggttatttgacttaaactttattaccgtntactaacaagtacttaactacttaccgtacggggtaccgttcggaaccggtaaacgggaaccgtaaagggtaacggtaaaacttaacgaaaacgtaaccgtaggtacgcgtacgacctaactacg

SEQ ID NO: 342659 - DNA, 488 bp, Homo sapiens
  misc_feature: GZ8MTXP02JYLUY.4.74.G08.1.454.CMB.2.raw
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (488)..(488): a, c, t, g, unknown or other
  misc_feature (488)..(488): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacgcccctaagctctgatctacgctgcgtctagttcagagtggagtccccatcaaggttcagcgcagtggatctggcacgagtatttcactctcaccatcagcagcctgcagacctgaggtatttgactacttatacttntacanatactactactacgtcggtacgtcggacgtaacggacgtagacgaactacaacgacgtgtcgctacacactn

SEQ ID NO: 342660 - DNA, 537 bp, Homo sapiens
  misc_feature: GZ8MTXP02F0IDK.4.74.G08.1.454.CMB.2.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtancagcaagaaaccagggaaancccctaaagctcctgatctacgctgcgtctagtttacagagtggacgtccccatcaaggttcagcggcagtggatctggcacagatttcactctcaccatcagcagcctgcagcctgaggtattttgactaaacttattactgtactacaaagtacttaacactttaccccgtagggtaccgtttacggaccgaaagggaacccaaagggttaaggaaaacttaacaaaaacggtaacttaggtacggactacgaccactaacg

SEQ ID NO: 342661 - DNA, 513 bp, Homo sapiens
  misc_feature: GZ8MTXP02IYSKT.4.74.G08.1.454.CMB.2.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (331)..(332): a, c, t, g, unknown or other
  misc_feature (331)..(332): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatcgaaatgagtanctgtatcagcagaaacagggaaacncccctaagctctgatctacgctgcgtctagttacagtagtggagtccccatcaagttcagcgnnggtgatcgtgcacagtattcactctcacatcagcagcctgcagcctgtaggtattttgactaacttattactgtactacaaagtattacactttacccgtcgggtacgttcggaccgaaacgggaccgtaagggaacggtaaactaacgaaaacgtaactggtacggctacgactacctag

SEQ ID NO: 342662 - DNA, 528 bp, Homo sapiens
  misc_feature: GZ8MTXP02GCQ8G.4.74.G08.1.454.CMB.2.raw
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcaagaaaccaggggaaacncccctaagctcctgatctacgctgcgtctagtttacagagtggactccccatcaagtcagcgcngtgatcgtgcacagtatttcactctcaccatcagcagcctgcagcctgagtntttgactaacttattactgtactacaaagtacttaacaactttacccgtagggtaccgtttacggaccgaaacgggtaccgaaagggtacggaaaactaacgaaaacgtaacgtaggtacggactacgacaacctac

SEQ ID NO: 342663 - DNA, 540 bp, Homo sapiens
  misc_feature: GZ8MTXP02GWP0I.4.74.G08.1.454.CMB.2.raw
  modified_base (246)..(246): a, c, t, g, unknown or other
  misc_feature (246)..(246): n is a, c, g, or t
  modified_base (340)..(340): a, c, t, g, unknown or other
  misc_feature (340)..(340): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaanctggtatcagcaagaaaccagggaaagcccctaagctcctgatctacgctgcgtctagtttacagagtggagtcccccatcaagttcagcggcngtgatctgcacagatttcactctcacatcagcagcctgcagcctgacggtattttagactaacttattacctgtactactaaagtattacacttacccgtgggtacgttccggaccgtaaacgggaccgtaaagggtacggaaaacttacgaaaaccggtaaaccgttaggtacgggtcctacggacctaaccgttaacg

SEQ ID NO: 342664 - DNA, 652 bp, Homo sapiens
  misc_feature: GZ8MTXP02HGBAD.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccggganaagtcaggacatacgaatggaggtaagctggatcagacaagaaaccgaggaaacncccctaagcctctgatactacgctcgcgttacttagttacagtagtacggactccccatacgaaggttcaggcgcagtggatcgtggacacgagtactttacaccttactaccacctactacacgacgaacgcccgtagcccgaaggtacccgtaggtaaggttacgtttttacgaacctttaaaccgtttaactttaaccgtttacggttaaccttaaactaaaggttaacctttaaccgtaacccgtttaacccgtacgggggttaaccgtttacccgggaaacccgaaacggggtaaacccgtaaacggggttaaggtaaaaccgtaacgtaaaaccggtaacgttacggtacggtactacggacctaactaacg

SEQ ID NO: 342665 - DNA, 517 bp, Homo sapiens
  misc_feature: GZ8MTXP02JR33O.4.74.G08.1.454.CMB.2.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (394)..(394): a, c, t, g, unknown or other
  misc_feature (394)..(394): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttggccgggcaagtcaggacatccgaaatggaggtaagctggtancagcaagaaaccagggaaacncccctaagctcctgactctacgctgcgtactagttacagagtggatccccatcaagtcaggcgcaggtcgatcgtgcacgagtacttcactctcacatcagcagcctgcagctgagtntttgctacttatactgtactaacaagtacttaccacgttaccgtacgggtacgttccggacgaaacgggaccgtaaggtagtaaactacgaaaacgtactacggtaggactacgaccaccgta

SEQ ID NO: 342666 - DNA, 563 bp, Homo sapiens
  misc_feature: GZ8MTXP02HNQRD.4.74.G08.1.454.CMB.2.raw
  modified_base (245)..(245): a, c, t, g, unknown or other
  misc_feature (245)..(245): n is a, c, g, or t
  modified_base (251)..(252): a, c, t, g, unknown or other
  misc_feature (251)..(252): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (327)..(327): a, c, t, g, unknown or other
  misc_feature (327)..(327): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccacgatggccccagtctccgaggttacctgtctgcgtatgtcggagacagagtcaccatcacttgccgggcaagtcaggacatcgaatgagtanctgtannancagaacgagacncctanctcnatcacnctgtctatagttagagtagtcgactcccagtacgtagtcagtcggntgtgactcgcgactacgagtacttctactctacactagtcacgcacgctcgacgacgtacgtagtacggttagtttacgtacttacttacttacgttacgtactaacgtaacgtaacttaaccgtaccgttaccggttacggtacggttaccggtaccggtaacggtaacggtaacggtaacggtaaacgtaacgtaaacgtaacgtacggtacggtacgtacgtacgtacgtacg

SEQ ID NO: 342667 - DNA, 634 bp, Homo sapiens
  misc_feature: GZ8MTXP02IL7X7.4.74.G08.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (327)..(327): a, c, t, g, unknown or other
  misc_feature (327)..(327): n is a, c, g, or t
  modified_base (418)..(418): a, c, t, g, unknown or other
  misc_feature (418)..(418): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagatcacatcacttgccgganaagtcgaggacataccgaaatggaaggtaagctggtatcgagacaaggaaaccagggaaaccgcccctaagcctacctgactcctacgctgccgttactaagtttacagnggtaggacgtacccccatcgaaggttcaggtccggcagggtgatcgtggacctacgagttacttcactcctcacatacagccagcctgacncgaccgtagtaggtttacttttagaccttaactttaacttaacttacgttaactaaacgttaaacgtactttaaaccgtaaccgtttaacccggttacggggtacccggtttaccggggaacccgtaaaacggggtaaaccgtaaaggggtaacggtaaaacgtaaccgtaaaacgtaacgtacggttacggacgtacggtaacctaacgttaacg

SEQ ID NO: 342668 - DNA, 542 bp, Homo sapiens
  misc_feature: GZ8MTXP02HRMHU.4.74.G08.1.454.CMB.2.raw
  modified_base (219)..(219): a, c, t, g, unknown or other
  misc_feature (219)..(219): n is a, c, g, or t
  modified_base (344)..(344): a, c, t, g, unknown or other
  misc_feature (344)..(344): n is a, c, g, or t
  modified_base (402)..(402): a, c, t, g, unknown or other
  misc_feature (402)..(402): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagcagaaaccagggaaacgcccctaaagctcctgatctacgctgcgttctagtttacagtagtggacgtcccccatcaaggttcagccgnagtggatctggcaacgagtactttcactctcacatcagcagcctgcagccgtgaggtntttttgactaactttatttacgtcgtactaacaagtacttacgtaccttaccgtgggtacgtttccgggaaccgaaacgggtaccgtaaagggtacggtaaaactacgaaaacgtaacgtggtacggctacgacactacg

SEQ ID NO: 342669 - DNA, 587 bp, Homo sapiens
  misc_feature: GZ8MTXP02IJXW8.4.74.G08.1.454.CMB.2.raw
  modified_base (286)..(286): a, c, t, g, unknown or other
  misc_feature (286)..(286): n is a, c, g, or t
  modified_base (553)..(553): a, c, t, g, unknown or other
  misc_feature (553)..(553): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagactcaccatcacttggccgggacaagtcaggacagtaccgaaaatggaaggtaagcgtaggtactcagacaacgaaaccagggaaacncccctaagctcctgactctacgctcgcgttcttagttacagtagtggtacgtccccatcaaggttcaggtcggacaggtgatccgtaggacacagttactttacactctcactatcgagccgagccgtcgacgacgaccgttaggtaggttacttttacgactttaacgtttaattaccgttagtaactaactaaagttacttaaccgtacgtttacccgtcgggtaccgttacggaccgtaaacgggaactacgggtaaacgtaanaacgaaagtaacgtcggtacgacgtcacactacg

SEQ ID NO: 342670 - DNA, 509 bp, Homo sapiens
  misc_feature: GZ8MTXP02JM7P9.4.74.G08.1.454.CMB.2.raw
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggcatccgaaatgaggtaanctggtancagcaagaaaccagggaaacncccctaagctcctgatctacgctgcttctagtttacagngtggatccccatcaaggttcagtgcagtgatcgtggcacagtattcactctcaccatcancagcctgcagcctgaggtattttagactaactttatacttntactaacaagtattaacacttaccgtacgggtacgttacggaccgtaagggacaacggtacgaaactacgaaacgactacgtggactgacactacg

SEQ ID NO: 342671 - DNA, 516 bp, Homo sapiens
  misc_feature: GZ8MTXP02GG5JS.4.74.G08.1.454.CMB.2.raw
  modified_base (194)..(194): a, c, t, g, unknown or other
  misc_feature (194)..(194): n is a, c, g, or t
  modified_base (386)..(386): a, c, t, g, unknown or other
  misc_feature (386)..(386): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcagaaaccagggaaagcccctaagctcctgatctacgctgcgtctagtttacagagtggactccccatcaagttcagcggcagtgatctgcacagatttcactctcacatcagcagctgcagcctgagtnttttgactaacttattactgtactacaagtacttactacttaccgtgggtaccgttcggaccgaaacgggaccgtaaggtacggaaactacgaaaaccgtaacgtacggttacgacgtacgaccactacg

SEQ ID NO: 342672 - DNA, 507 bp, Homo sapiens
  misc_feature: GZ8MTXP02IZUZ4.4.74.G08.1.454.CMB.2.raw
  modified_base (342)..(342): a, c, t, g, unknown or other
  misc_feature (342)..(342): n is a, c, g, or t
  modified_base (420)..(420): a, c, t, g, unknown or other
  misc_feature (420)..(420): n is a, c, g, or t
tcagagcactgtagcacgaccggtgctcgatttagtagctctatcaggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaagcccctaagctcctgactctacgctgcgtctagtttacagagtggagtcccccatcaaaggttcagcggcnggtggatcgtggcacagatttcactctcaccatcagcagcctgcagcctgagtattttgctaattattactgtactanaaagtattaacacttacccgtgggtacgttcggaccgaagggaccgaacggtacggaaatacaaacgtactagtggactgacaccta

SEQ ID NO: 342673 - DNA, 548 bp, Homo sapiens
  misc_feature: GZ8MTXP02JAIBJ.4.74.G08.1.454.CMB.2.raw
  modified_base (220)..(220): a, c, t, g, unknown or other
  misc_feature (220)..(220): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggganaagtcaggacataccgaaatggaggtaagctaggtatcgagacaagaaaccgagggaaacgcccctaagcctcctgactctacgctgcgtacttagtttacagtagtggacgtcccccatacgtaaggttcaggcggcaggtgatcgtggacacagtactttacactcctacacctatacgagccagccctgacagcctggtaggtatttcgacttaactttattacgtagtactaacaagtacttaaccacttaccgtgggtaccgtacggaccgaaaggacctaagggtacgaaactacgaaacgactcgtacggctcgacactac

SEQ ID NO: 342674 - DNA, 493 bp, Homo sapiens
  misc_feature: GZ8MTXP02H29XD.4.74.G08.1.454.CMB.2.raw
  modified_base (194)..(194): a, c, t, g, unknown or other
  misc_feature (194)..(194): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttggccggcaagtcaggacatcgaatgagtagctgtancagacaagaaccaggaacnccctaagctcngatcacgctgctntagttacagagtgatccccatcaagtcagcgacnggtgatcgtgcanatacttcactctcacatcagcagtccagcagcctgacggttatttgactaattatactgtactacaagtacttacacttaccgtaggtacgttacggacgtaaacgggactaacggtagtaaacacgaaacgtacgtagtcggactcgactactac

SEQ ID NO: 342675 - DNA, 563 bp, Homo sapiens
  misc_feature: GZ8MTXP02F3Q0M.4.74.G08.1.454.CMB.2.raw
  modified_base (194)..(194): a, c, t, g, unknown or other
  misc_feature (194)..(194): n is a, c, g, or t
  modified_base (344)..(345): a, c, t, g, unknown or other
  misc_feature (344)..(345): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttggccgggcaagtcaggacataccgaaatggaggtaagctggtatcagacaagaaaccgagggaaacgcccctaaagcctcctgatctacgctgcgtctagttacagagtggactccccatcaagttcagcgnngtgatcgtgcacagtactttcactctcacctatcagccagcctgacagcctgaggttatttgacttaactttatactttgtactaactaaagtacttaacctaccgtttaaccccggtaggggtaccgtttacgggacccgaaaacggggtaacccgaaaggggtaacgtaaaataaccgaaaacggtaaccttggttacgcgtacgacctactaacg

SEQ ID NO: 342676 - DNA, 525 bp, Homo sapiens
  misc_feature: GZ8MTXP02FT020.4.74.G08.1.454.CMB.2.raw
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacgcccctaaagctcctgatctacgctgcgtctagtttacagagtggagtccccatcaagttcagcggcaggtgatcgtggcacagtatttcactctcacatcagcagcctgcagcctgaggtattttgctaaacttattactgtactacaagtattactacttaccgtgggtacgttcggaccgaaaggggtaccaaagggttaacggaaacgttaacgaaaacgaacgtggtacggctacggccaacttacg

SEQ ID NO: 342677 - DNA, 585 bp, Homo sapiens
  misc_feature: GZ8MTXP02J2YP4.4.74.G08.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
tcagagcactgtagcacgaccggtgctcgatttagtagctctatcagggggcaggagtcagacccactcaggacacagcatggacatgagggtcccccgctcagctcctggggctcctgctgctctggctcccaggtgccagatgtgccatccagatggcccagtctccaggttacctgtctgcgtatgtcgganacagagtcaccatcacttgccggnaagtcaggacatccgaatgaggtaagctggtancagcaaggaaaccagggaaacncccctaagcctacctgactctacgctgcgtctagttacagagtggacgtccccatcgaaggttcagcggcagggtggaactcgtaggcaactagtacttcaactctacaccatcacgcacgcctagcacgtccgtaggtaggttattttcgacttaaactttaacgttacgtacgttactaaacgtaacgttacttaacctaaccgtttacccggttacggggtaccggttaccgggaacggtaaacgggaccgtaaggtaacggtaaactaaccggaaacgtaacgtggtacggtcacgtaccacgttac

SEQ ID NO: 342678 - DNA, 510 bp, Homo sapiens
  misc_feature: GZ8MTXP02IK0Q3.4.74.G08.1.454.CMB.2.raw
  modified_base (275)..(275): a, c, t, g, unknown or other
  misc_feature (275)..(275): n is a, c, g, or t
  modified_base (420)..(420): a, c, t, g, unknown or other
  misc_feature (420)..(420): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacataccgaaatgaggtaagctggtatcagcaagaaaccagggaaacncccctaagctcctgatctacgctgcgttctaagtttacagagtggagtcccccatcaaaggttcagcggcagggtgatcgtggcacagtatttcatctcaccatcagcagcctgcagcctgaggtattttgactaattattactntactaacaaatattacacttacccgtggtacgttcggaccgtaaagggaccaaggtacgaaatacaaagtaactgtcgactcgacactac

SEQ ID NO: 342679 - DNA, 566 bp, Homo sapiens
  misc_feature: GZ8MTXP02H0DUC.4.74.G08.1.454.CMB.2.raw
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
tcagagcactgtagcacgaccggtgctcgatttagtagctctatcagggggcaggagtcagacccactcaggacacagcatggacatgagggtccccgctcagcctcctggggctcctgctgctctggctcccaggtgccagatgtgccatccagatggcccagtctccaggttacctgtctgcgttatggtcggagacagagtcacatcacttggccgggnaagtcaggacatccgaaatggaggtanctggtancagacagaaaccgaggaacncccctaagctcngactcacgntgcttattagttacagtagtgactccccagtacgagtcaggcganggtgattccgngacacgtagtctttacactcctacacatcagcacgcctagcacgctaggagttnttttacgacttaacgttattacgtacgtactaacgaagttacttaaccgtaccgtttaacccggtggggtaccgttacgggaccgaaacggggtaacctaagggtaacgtaaaactacgaaaaacgtacgttaggaccggtctaacggtaccaaccttg

SEQ ID NO: 342680 - DNA, 573 bp, Homo sapiens
  misc_feature: GZ8MTXP02HGLQV.4.74.G08.1.454.CMB.2.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (344)..(345): a, c, t, g, unknown or other
  misc_feature (344)..(345): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagacgtcaccatcacttggccgggacaagtcaggacatacgaatgagtagctgtancagacaagaaacgaggaaacncccctaagcctcctagactctacgtctagtcgtacttagttacagtagtgactccccatcgaagtcagcgnngtgatcgagacacgagttacttacactcctacacatcagcacgtctcgacgacgtacgtagtacgttattttacgacttaactttacttacttagttacctaaacgtaagtacttaaccgtacgttacccggtacgggtaccgttaccggaaccgaaacggggtaacctaagggtacgtaaaacgtacgaaaacggtcgttacggtcggtactacgactaaccgttag

SEQ ID NO: 342681 - DNA, 550 bp, Homo sapiens
  misc_feature: GZ8MTXP02IWA6I.4.74.G08.1.454.CMB.2.raw
  modified_base (218)..(218): a, c, t, g, unknown or other
  misc_feature (218)..(218): n is a, c, g, or t
  modified_base (345)..(345): a, c, t, g, unknown or other
  misc_feature (345)..(345): n is a, c, g, or t
  modified_base (441)..(441): a, c, t, g, unknown or other
  misc_feature (441)..(441): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgcgggnaagtcaggacatccgaaatgaggtaagctggtatcagcaaggaaaccagggaaacgcccctaaagcctcctgatctacgctgcgttctagtttacagtagtggatccccatctaaggtcaggcggcnggtgatcgtggacacgagtattcactctacaccatcagcacgccctagcacgtcctaggtaggtattttgacttaaccttattacctgttactaanaagtacttaacgtaccttaacccgtgggtaccgttcggaccgtaaacggggaccgtaaacggtacggaaatacgaaaacgtacgtacggtacgcgtacgacctacgtac

SEQ ID NO: 342682 - DNA, 530 bp, Homo sapiens
  misc_feature: GZ8MTXP02JCJF7.4.74.G08.1.454.CMB.2.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccgggnaagtcaggacatccgaaatgaggtaagctggtatcagcaagaaaccgagggaaacncccctaagctcctgatcacgctgcgttctagtttacagtagtggacgtcccccatacgaaggttcaggcggcnggtggatcgtggcactagtactttcactctcaccatcancacgcctgcagcctgagttatttcgacttaacttatacgtgtactaactaagtacttaactacttaccgtgggtaccgttcggaccgaacggaacgaacggtacgaacgtaacaaacgaacgtagtcggactcgacactacg

SEQ ID NO: 342683 - DNA, 565 bp, Homo sapiens
  misc_feature: GZ8MTXP02FMM10.4.74.G08.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacgttcgccggganaagtcaggacatacgaaatgaggtaagctggtatcagacaagaaaccgaagggaaacgcccctaagctcctgatctacgctgcgtctagtttacagagtggatccccatacaagtcagcgcaggtgatcgtgcactagtactttcactctcacatcagcagcctgacacgtcgtagaggttatttagacttaaactttattactgtactaaacaaagttacttacctaccgttaacccgtagggtaaccgttcggaaccgaaaacggggaaaccgtaaaggggtaacgaaaacgtaaccgtaaaaacggaactttagggcggttactacggacctacctaacg

SEQ ID NO: 342684 - DNA, 609 bp, Homo sapiens
  misc_feature: GZ8MTXP02GE1J9.4.74.G08.1.454.CMB.2.raw
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcaccatcacgttggccgggnaagtcaggacataccgaaatggaggtaagctaggtatcgagacaagaaaccgagggaaacncccctaagctccagactctacgctgcgtcttagttacagtagtcggactccccatcgaagtcgaggcgngaggtgatcgtgacacgtagtacttcacttcacaccatcgacgcacgcctgacacgtccgtaggtaggttattttacgactttaactttagttacctacgttacctaacgtaaacgttacttaacccgtacccgtttacccggtacgggggtacccggttaccgggaacccgggtaaaacgggaaccgtaaaggggttaacggaaaacttaaccgaaaacggtacgttacggtacggtctacggacctaacccgtag

SEQ ID NO: 342685 - DNA, 552 bp, Homo sapiens
  misc_feature: GZ8MTXP02HEZ6X.4.74.G08.1.454.CMB.2.raw
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (446)..(446): a, c, t, g, unknown or other
  misc_feature (446)..(446): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtccaacatcacgttggccggacaaggtcaggacatacgaaatggaggtaagcgtggtatcagacaacggaaaccgagggaaacncccctaagcctcctagactctacgctgcgttacttagttacaggtagtggactaccccatacgagttcagccganggtgatcgtagacatagttattccactctacacagtcagcagtcngcagcctagagttatttgacttaattactacgtgtactaanaagtacttaccgtacttacccggtaggtaccgttacggaacgaacgggtaaccgaaggtaacgaaactaacgaaacggtacgtacggtaggactcgacctaactcg

SEQ ID NO: 342686 - DNA, 625 bp, Homo sapiens
  misc_feature: GZ8MTXP02I55NU.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcgganacagagtcaccatcacttgccgggnaagtcaggacataccgaaatgaggtagctgtatcagcaagaaaccgagggaaacnccctaagcctcctgactctacgctgcgttcttagttacagtagtcggactccccatacgaaggttcaggcggctagggtcgatcgtggacacgtagttcttaccacttccacaccatcgacgtcacgtccgtgaccgagtccgtaggtacggttatttttacgaacctttaactttaacgttaccttacgttaactaacgtaaaacgttaccttaacgtaacccgtttaccccggtacggggttacccggttaccgggaacccggtaaaacggggtaacccggtaaagggtaaacggtaaacgtaaccgaaaacgtaccggtaggtacggtcgtacgacctaacgttacg

SEQ ID NO: 342687 - DNA, 516 bp, Homo sapiens
  misc_feature: GZ8MTXP02I32B5.4.74.G08.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
tcagagcactgtagcacgaccggtgctcgatttagtagctctatcagggggcaggagtcagacccactcaggacacagcatggacatgatggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaantggtatcagcagaaaccagggaaacnccccaaagctcctgatctacgctgcgtctagtttacagagtggacgtcccatcaaggttcagcgnagtggatctggcacagtatttcactctcacntcagcagcctgcagcctagaggtattttgctaaaccttattactgttctaaactagtattacctacttacccgtgggtaccgttcgggaccaaacggggaccaaaggtaggaaaactaacgaaacgtaactgtaggctacgactaacg

SEQ ID NO: 342688 - DNA, 577 bp, Homo sapiens
  misc_feature: GZ8MTXP02JXY1Z.4.74.G08.1.454.CMB.2.raw
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (340)..(341): a, c, t, g, unknown or other
  misc_feature (340)..(341): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtancagcagaaaccagggaaacncccctaagctcctgactctacgctgcgtactagttacagagtggagtccccatcaaggtcaggcggnnggtgatcgngcanagtacttcactcacacanacagcacgtccncgacgacgacgtaggtaggttagtttacgtacttaactttaacttaacttacgttactaactaaacgtaacttaacctaaccgttaaccgtacggtaccggttaccggtaccggtaaacggaaaccggtaaacggtaacggtaaacgtaaacgtaaaacgtaaacgtacggtacgtacgtacgtacgtactac

SEQ ID NO: 342689 - DNA, 506 bp, Homo sapiens
  misc_feature: GZ8MTXP02IFXRT.4.74.G08.1.454.CMB.2.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
  modified_base (496)..(496): a, c, t, g, unknown or other
  misc_feature (496)..(496): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcaagaaaccagggaaacgcccctaagctcctgactctacgctgcgttctagtttacagagtggacgtccccatcaagttcagcggcnggtgatcgtggcacagtattcactctcacatcagcagcctgcagcctaggtaggtattttgactaactttatactgtactacaatattacacttaccgtacggtacgttcggaccgaaagggaccaggtacgaatacaaacgtactagtacgntcgacactac

SEQ ID NO: 342690 - DNA, 520 bp, Homo sapiens
  misc_feature: GZ8MTXP02IDE3P.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaaatgaggtaagctggatcagcagaaaccagggaaagcccctaagctcctgatctacgctgcgtctagtttacagagtggatccccatcagttcagcgcngtgatctggcacagtattcactctcacatcagcagcctgcagcctgagtatttttgacttaacttattactgttactaacaagtacttactacttaacccgtcgggtaccgtttccggacctaaacggggacctaaacgggtacggaaacttacgaaaacgtactacgtcggactcgacaccgtac

SEQ ID NO: 342691 - DNA, 612 bp, Homo sapiens
  misc_feature: GZ8MTXP02FKFF3.4.74.G08.1.454.CMB.2.raw
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacgttggccgggcaagtcaggacataccgaaatgaggtaagctaggtancagcaagaaaccgagggaaacncccctaagcctcctgatctacgctgcgtctagttacagtagtggactccccatcgaaggtcagcggcaggtggatcgtggacacgagtactttcactcctacaactatcagcagtcctgacacgtccgtaggtaacggttattttacgaccttaaaacttttacttaaccttcggttaacctaaacgtaacgtaactttaacctaacccgtttaccccggtacgggggtacccgttaccgggaccggtaaaacggggacccgtaaaaggggttaacgaaacgtaaaccgaaaacggtaacgttacggtcggaccttacggaccctacctaacg

SEQ ID NO: 342692 - DNA, 557 bp, Homo sapiens
  misc_feature: GZ8MTXP02JGBM6.4.74.G08.1.454.CMB.2.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (441)..(441): a, c, t, g, unknown or other
  misc_feature (441)..(441): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagacaagaaaccgagggaaacncccctaagctcctgactctacgctgcgtctagttacagtagtggactccccatcgaagtcagcggcaggtggatcgtggcaactagtatttccactctacaccatcagccacgcctgcagtccgtaggtaggttacttttgacttaactttattactgtactaanaagtacttaacctacgttacccgtggggtaccgtttacgggaacgttaaacggggaaccgtaagggttaacgaaaactaacgaaaacgtacgtaggtacggactacgaccacttac

SEQ ID NO: 342693 - DNA, 506 bp, Homo sapiens
  misc_feature: GZ8MTXP02FQLBN.4.74.G08.1.454.CMB.2.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (343)..(343): a, c, t, g, unknown or other
  misc_feature (343)..(343): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctcaggttacctgtctgcgtatgtcgganacagagtcacatcacttgccgggnaagtcaggacataccgaaaatgaggtaagctggtatcagcaagaaaccaagggaaacgcccctaaagctcctgatctacgctgcgtctagtttacagagtggatccccatcaaagttcagcggacngtggatcgtggcaacagtattttcacttcctacaaccataccagccagcctgacagcctgagttatttgactaattattactgtactacaagtattacacttaccgtggtacgttcggacgaaaggtacaagtacgaatacaaagactagtcgactcgcacta

SEQ ID NO: 342694 - DNA, 561 bp, Homo sapiens
  misc_feature: GZ8MTXP02GHWVB.4.74.G08.1.454.CMB.2.raw
  modified_base (220)..(220): a, c, t, g, unknown or other
  misc_feature (220)..(220): n is a, c, g, or t
  modified_base (277)..(277): a, c, t, g, unknown or other
  misc_feature (277)..(277): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatcggcccagtctccaggttacctgtctgcgtatgtcggagacagagtcaccatcacttgccgggnaagtcaggacatacgaaatgaggtaagctggtatcagacaagaaaccgagggaaacncccctaagcctcctgatctacgctgcgtcttagtttacagagtggacgtccccatcgtaaggttcaggcggactaggtggatcgtaggcaacgagtactttcacttctacacatcagcagctgcagcctaggagttatttacgacttaactttattacctgttactaataagtacttaccgtaccgtttaccgcgggttaccgttacgggaaccgtaaacgggaaccgtaaaggtacgaaaactaacgaaaaccgtactcggtagacctacgtaccacgttacg

SEQ ID NO: 342695 - DNA, 533 bp, Homo sapiens
  misc_feature: GZ8MTXP02GKC8D.4.74.G08.1.454.CMB.2.raw
  modified_base (397)..(397): a, c, t, g, unknown or other
  misc_feature (397)..(397): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcaagaaaccagggaaacgcccctaagctcctgatctacgctgcgtctagtttacagagtggatcccccatcaagttcagcggcaggtgatcgtggcacgagtatttcacttctcacatcagcagcctgcagcctagaggtnttttgactaacttatactgtactaacaagtacttactacgttacccgtacgggtacgttcggaccgaaacgggaccgaaggtacggaaacttacgaaaacgtaaccgtaggtacggacgtacgaccgtaaccctag

SEQ ID NO: 342696 - DNA, 516 bp, Homo sapiens
  misc_feature: GZ8MTXP02IE3SG.4.74.G08.1.454.CMB.2.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgcggcaagtcagacatcgaaatgagtanctgatcagcagaaaccagggaaacgcccctaagctccngactctacgctgcgtacttagtttacagagtggtacgtcccccatcgaaggttcagcggcaggtgatcgtggcacagtacttcactctcacatcagcacgcctgcacgcctgtacgttattttcgacttaactttatactgtactataagtattactacttaccgtacggtacgttcggaccgtaaagggactaacggtaggaaactaacgaaacgtaacgtgtacggctcgactacta

SEQ ID NO: 342697 - DNA, 514 bp, Homo sapiens
  misc_feature: GZ8MTXP02G01V3.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatccgaaatgaggtagctggtatcagcaagaaaccagggaaacncccctaagctcctgactcacgctgcgttactagttacagtagtggactcccccatcaaggttcaggcgcnggtgatcgtggcacagtactttcactctcacatcancagcctgcagcctgagtatttgactaattatactgtactagaatacttacacttaccgtcgggaccgttacggaccgtaaagggaccaaggtacggaaactacgaaaacgtactcggtacggactacgacactac

SEQ ID NO: 342698 - DNA, 547 bp, Homo sapiens
  misc_feature: GZ8MTXP02G8QRJ.4.74.G08.1.454.CMB.2.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
  modified_base (388)..(388): a, c, t, g, unknown or other
  misc_feature (388)..(388): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccgggnaagtcaggacatacgaaatgaggtaanctggtatcagacaagaaaccgagggaaacncccctaagcctacctgactctacgctgcgttctagttacagagtggactccccatcgaaggttcaggcggcaggtggatcgtgacacagtactttcactctacaccatcancacgcctgacagccgtagacggtattttcgacttaactttacttactgtactaacagtacttactacttaccggtcggtaccgttcggaccgaaacgggaccgtaaagggtacgaaaactacgaaaacgtacgtaggtacggactacggaccaactacg

SEQ ID NO: 342699 - DNA, 603 bp, Homo sapiens
  misc_feature: GZ8MTXP02GTHFO.4.74.G08.1.454.CMB.2.raw
tcagagcactgtagcacgaccggtgctcgatttagtagctctatcagggggcaggagtcagacccactcaggacacagcatggacatgagggtccccgctcagctcctggggctcctgctgctctggctccaggtgccagatgtgccatccagatggcccagtctccaggttacctgtctgcgttatgtcggagacagagtcaccatcacttgccgggcaagtcaggacatccgaaatgaggtaagctggtatcagcaagaaaccagggaaacgcccctaaagctcctagatctacgctgcgtactagtttacagagtggagtcccccatcaagttcaggcgcagtggatcgtggcacagatttcactcctacacctatcaagcacgcctcgcacgacccgtacgtaggtacggttttagttacttaaacctttaatttaacgttacgttacttaacctaaagtaacttaacctaccgttaacccgttacgggtaccggtttaccgggtaccgtaaaccgggaaaccggtaaacggttaacggaaaacgttaaacgtaaaacgaaaccgtaacgttaggtacggtacgtaccgaacctaaccg

SEQ ID NO: 342700 - DNA, 650 bp, Homo sapiens
  misc_feature: GZ8MTXP02H44KP.4.74.G08.1.454.CMB.2.raw
  modified_base (194)..(194): a, c, t, g, unknown or other
  misc_feature (194)..(194): n is a, c, g, or t
  modified_base (632)..(632): a, c, t, g, unknown or other
  misc_feature (632)..(632): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcactggccgggacaagtcaggacacgtacgaaatggaaggtaagctaggtatcgagacgaaacggaaaccgaaggggaaaccaccccgtaaagcctccgtaggaactccgtacgtctcggtaccgtttacgtttaacggtttaacagggtaacggtacgggtacctaccccctaagttaccgtaaagggttaccgacgggccgggtactaggggttacggaacgtttccggtagggtaacctaacgtagttacttttacccgaccttcctacaacccctatacccgaagccaacgtccctagcacgtcgtaggttaggtttactttgacttaacgtttatactgtaactaacgaattaacttacgtaccgttaccggtggtaccgttaccggacgaacggtaacaagggtaacaaatacaaacgtntacggcgactcgacactg

SEQ ID NO: 342701 - DNA, 521 bp, Homo sapiens
  misc_feature: GZ8MTXP02IKEZR.4.74.G08.1.454.CMB.2.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcagaaaccagggaaacncccctaagctcctgatctacgctgacgtctagttacagtagtggagtccccatcgaagttcagcggcaggtggatcgtcggcacgtagtactttcactctacaccatcagcagcctgcagctgagtatttgactaacttatactgtactactaagtattacactttaccgtacgggtacgttcggaccgaacgggaccgaagggtacgaactacaaaacgtacgtaggtacgtactacggacactacg

SEQ ID NO: 342702 - DNA, 518 bp, Homo sapiens
  misc_feature: GZ8MTXP02GGVZY.4.74.G08.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (336)..(337): a, c, t, g, unknown or other
  misc_feature (336)..(337): n is a, c, g, or t
  modified_base (349)..(349): a, c, t, g, unknown or other
  misc_feature (349)..(349): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccggnaagtcaggacatccgaaatgaggtagctggtatcagcaagaaaccgaggaacgcccctaagctcctgatctacgctgcgttctagtttacagagtggacgtccccatcaagtcagcgnngtgatcgtgcanagtatttcacttctcaacatcagcagccctgacacgcgtgtagttnttacgacttaactttatacgtntactaacgaattactactacgtaccggtggtaccgtacgaaccgaacggacgtaaggaacgaactacgaaacgtacgtacggtcgactacgacctactacg

SEQ ID NO: 342703 - DNA, 649 bp, Homo sapiens
  misc_feature: GZ8MTXP02G4YVF.4.74.G08.1.454.CMB.2.raw
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccgggacaagtcaggacataccgaaatggaggtaagcgtaggtatcagacaagaaaccgagggaaacgacccctaagctacctgactctacgctgcgttntagtttacagtagtcggatcccccatcgaaggttcagcggcngttggatcgtggactacgtagtacttaccactcctaccaccatcgacgcaacgtcctgaccgacgtccgtaggtaaggttacttttacggactttaaacgtttacttaaccgttacgttaaccgttaaactaaacgttaaacttaacccgttaaccgtttaacccccggtacgggggttaaacccggtttaccggggaacccgtaaaacgggggtaaccgtaaacggggtaacggtaaaacgttaccgaaaaaccggtacgtacggggtacgtacgtaccgacctaccttacg

SEQ ID NO: 342704 - DNA, 527 bp, Homo sapiens
  misc_feature: GZ8MTXP02IIJNO.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (419)..(419): a, c, t, g, unknown or other
  misc_feature (419)..(419): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggnaagtcaggacatcgaaatgagtaanctggtatcagcaagaaaccaggaaacncccctaagctcctgactctacgctgcgtctagtttacagagtggactccccatcaagttcagcggcagtggatcgtggcacgagtactttacactctacacatcagcagcctgcagcctgagtattttgacttaactttattaccgtnttactactaagatttactacttacccgtagggtaccgttcggacgtaaacggaaccgaaggtaacggaaattacgaaaacgtacgtagtacggacttcgaccactacg

SEQ ID NO: 342705 - DNA, 552 bp, Homo sapiens
  misc_feature: GZ8MTXP02IYLLU.4.74.G08.1.454.CMB.2.raw
  modified_base (250)..(250): a, c, t, g, unknown or other
  misc_feature (250)..(250): n is a, c, g, or t
  modified_base (282)..(282): a, c, t, g, unknown or other
  misc_feature (282)..(282): n is a, c, g, or t
  modified_base (346)..(347): a, c, t, g, unknown or other
  misc_feature (346)..(347): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtccaccatcacgttgccgggcaagtcaggacataccgaaatggaggtaancgtaggtatcagacaagaaaccgagggaaacncccctaagcctctagactctacgctgcgttctagttacagtagtgactccccatcagtcagcgnngtgatcngcanagtattcactctcacatacancagcctgccgacgtccgtagtaggttacttttgactaactttattacctgtactactaagtacttaccgtacttacccgtacgggtaccgttacgggaccgaaagggtaccgtaaggtacgtaaacgtaccgaaaacggtaacgtacggtacggactacgacctaaccctacg

SEQ ID NO: 342706 - DNA, 606 bp, Homo sapiens
  misc_feature: GZ8MTXP02H85GP.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccggganaagtcaggacatacgaatgagtanctgancagcaagaacgaggaaacncccaagctcngatcgtacgctgtcgtntagttacaggtagtggactccccatcgaaagttcagtcgggactaggtggatcgtgacanagttacttcactctaccactancgancacgcccgtgacctagccgttaggaacgttattttacgacttaacttatttaacgtcgttaactaacgaaacgttacttaaccgtacccgttttaacccgggagggttacccggtttaccggaaacccggtaaaacggggaaaccgttaaaacggggtaaacgggtaaaacttaaccgaaaacggtaccttagggtacgggtacttaccggacctaaaccgttacg

SEQ ID NO: 342707 - DNA, 548 bp, Homo sapiens
  misc_feature: GZ8MTXP02JNZ1T.4.74.G08.1.454.CMB.2.raw
tcagagcactgtagcacgaccggtgctcgatttagtagctctatcagggggcaggggtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacataccgaaatgaggtaagctggtatcagcaagaaaccgagggaaacgacccctaagcctccgtagatctacgctgcgttctagtttacagagtggacgtccatcgaaggttcaggtcgcgagtgatcgtggacacgtagtactttcacttctactacccatcagtcacggctagcagtcctaggagtatttcgactactttattactgtactaactagtacttaccaccgtttaccgcggttacgtcggaccgaacgggtacgaaggttacgaaactacgaaacgtaactgggtaacgcttacgacctacctacgttcc

SEQ ID NO: 342708 - DNA, 523 bp, Homo sapiens
  misc_feature: GZ8MTXP02JZTXP.4.74.G08.1.454.CMB.2.raw
  modified_base (407)..(407): a, c, t, g, unknown or other
  misc_feature (407)..(407): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaacgcccctaagctcctgatctacgctgcgtctagttacagagtggatccccatcaaggttcagcgcagtggatcgtggacacgagtactttcactctcacatcagcagctgcagcctgacgtatttgactaactttntactgtactaacaagtacttactacgttaaccgttcgggaacgttcggaccgaaacgggaccgtaaagggtacggaaaactacgaaaacgacgtacggtacggactgaccacgtac

SEQ ID NO: 342709 - DNA, 602 bp, Homo sapiens
  misc_feature: GZ8MTXP02F6HFY.4.74.G08.1.454.CMB.2.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
tcagagcactgtagcacgaccggtgctcgatttagtagctctatcagggggcaggagtcagacccactcaggacacagcatggacatgagggtcccccgctcagctcctggggctcctgctgctctggctcccaggtgccagatgtgccatccagatggcccagtctccaggttacctgtctgcgtatgtcggagacagagtcaccatcacttggccgggcaagtcaggacataccgaaatgaaggtaagctaggtatcgagcaagaaaccgaagggaaacncccctaaagctcctagatcctacgctgcgtctagtttacagtagtgactccccatacgaagtcagcgcaggtggatcgtgcaacagtacttacactctacacatcancacgctgacagtccgtagtaaggttattttcgacttaaacctttattaaccgttacgtaacttaaactaaataactttaaaccgtacccttaacccggttaggggtaacccgtttaccggggaaccgaaaacgggggtaaacccggaaaggttaacgggaaaactaaccggtaaaaacgtacgttacgacgggtactacggacctaactaacg

SEQ ID NO: 342710 - DNA, 605 bp, Homo sapiens
  misc_feature: GZ8MTXP02FZ6K8.4.74.G08.1.454.CMB.2.raw
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacgttggccgggcaagtcaggacataccgaaatgaaggtaagctggtatcgagacaagaaaccgagggaaacgcccctaagctcctgactctacgctgcgttactagtttacagtagtggacgtccccatcaaggttcaggcggcaggtggatcgtgacagattcttacnctcacacatacganccactctcgacncgtactggtagttagtttcaacttaacttagttaccttgtaactaaacgtaacgtaacttaccgttaaccgttaccggtacgggttaccggttacggaaccgggtaaacgggtaaccggtaaaagggtaaaccggtaaacgtaaaccggaaaacggtaacgttacggggtacggacctttacggacccgaaccgtttaacg

SEQ ID NO: 342711 - DNA, 508 bp, Homo sapiens
  misc_feature: GZ8MTXP02IHDPJ.4.74.G08.1.454.CMB.2.raw
  modified_base (242)..(242): a, c, t, g, unknown or other
  misc_feature (242)..(242): n is a, c, g, or t
  modified_base (248)..(249): a, c, t, g, unknown or other
  misc_feature (248)..(249): n is a, c, g, or t
  modified_base (268)..(268): a, c, t, g, unknown or other
  misc_feature (268)..(268): n is a, c, g, or t
  modified_base (422)..(422): a, c, t, g, unknown or other
  misc_feature (422)..(422): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccggcaagtcaggacatcgaatgagtaanctgtannagacagaaaccaggaaacncccctaagctctgactctacgctgcgtcttagttacagtagtggactcccccatacgaaggttcagcgcaggtgatctggacacatattcactctcacatcagcagcctgacacgcctagagtattttagacttaacttattactagtactaanaagtattacaacttaccgtaggacgttcggaccgtaaagggacctaaggtacgaaatacaaaacgacgtagtaggatcgacactac

SEQ ID NO: 342712 - DNA, 569 bp, Homo sapiens
  misc_feature: GZ8MTXP02JA3LT.4.74.G08.1.454.CMB.2.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
  modified_base (339)..(340): a, c, t, g, unknown or other
  misc_feature (339)..(340): n is a, c, g, or t
  modified_base (348)..(348): a, c, t, g, unknown or other
  misc_feature (348)..(348): n is a, c, g, or t
tcagagcactgtagcacgaccggtgctcgatttagtagctctatcagggggcaggagtcagacccactcaggacacagcatggacatgagggtccccgctcagctcctggggcctcctgctgctctggctcccaggtgccagatgtgccatccagatggcccagtctccaggttacctgtctgcgtatgtcgganacagagtcaccatcacttgccgggcaagtcaggacatccgaaatgaggtanctggtatcagacaagaaaccgagggaaacncccctaagctcctgactctacgctgcgtctagttacagtgtggactccccatcgagtcagcgnngtgatcgngcatagtacttcactctacaccatcagccacgcctgccagtccgtaggtaaggttacttttacgaccttaacgtttacttacgttagtacctaacgtaattacttaacctaccgtttaacccgtacgggggtacccgtttacgggacccggaaagggtaaccgtaagggtaacggaaactacgaaaacgtacgtggtacggacttacggacctaccgtacg

SEQ ID NO: 342713 - DNA, 580 bp, Homo sapiens
  misc_feature: GZ8MTXP02I3WQ5.4.74.G08.1.454.CMB.2.raw
  modified_base (194)..(194): a, c, t, g, unknown or other
  misc_feature (194)..(194): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccgggcaagtcaggacatacgaaatgaggtagctggtatcgagacaaggaaaccgagggtaaacgcccctaagcctcctagactcctacgcgtgtcgttcttagttacaggtagtcggacgtccccagtcaaggttcgagtcggctaggtgatcgtggctacgagttattcactctacacntacgancctagcctgccagcctggtaggtntttgactaactttatacgtagtactaacaagttacttaacgtacctttacccggtacgggtaccgtttaccggggaaccgaaacggggtaaccgtaaagggtaacggtaaaacttaccgaaaaacggtaacgtcgtaggactacggaccaacgttac

SEQ ID NO: 342714 - DNA, 568 bp, Homo sapiens
  misc_feature: GZ8MTXP02HC35N.4.74.G08.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
  modified_base (528)..(528): a, c, t, g, unknown or other
  misc_feature (528)..(528): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgganaagtcagacatcgaatgaggtanctagatcagacagaaccgaggaacgacccctaagcctacctgactctacgctagtaccgttattagtttacaaggtacgtaggacctaccccccaatccgtaaacgggttcacggtcggactacgggtggtactcgtacgggacaacgtagtactttccaacttcctacaccatcagcncgctgacancgtgtagttctttgactaattatactatacgtaanaagtacttaacacttaccggtacggtacgttacggaaccgaagggtaccaagggtacgtaaanaccggtaaaacgtaacgtcggtacgctacgacaccttacg

SEQ ID NO: 342715 - DNA, 656 bp, Homo sapiens
  misc_feature: GZ8MTXP02FTPA4.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcgganacagagtcacatcacttgccggganaagtcaggacataccgaaatgaggtaagctggtancagacaagaaaccgaggaaacncccctaaagcctacctgactcgtacgctgtccgttcttaagtttacagaggtacggacgtcccccaatcgaaaggttcaggcggacgtgggtggaacttcgtacggaccaacgagttactttaccacttcctaccaacctactccgaaacgcctaacgtccccgtgaccgacggtaccgtagggtaaggtttaacttttcgaacctttaaaaccttttatttaacccgttagtttaactaaacttaaacggtacctttaaccgtaaacccgtttaccccgggtaggggtacccggtttaccggaaccggtaaacggggaccgtaagggtaaacgaaacttaacgaaaacgtacgtaggtacggactcgaccacttaacg

SEQ ID NO: 342716 - DNA, 550 bp, Homo sapiens
  misc_feature: GZ8MTXP02F4XK0.4.74.G08.1.454.CMB.2.raw
  modified_base (219)..(219): a, c, t, g, unknown or other
  misc_feature (219)..(219): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggnaagtcaggacatccgaaatgaggtaagctggtatcagacaagaaaccagggaaacgcccctaaagcctctgatcctacgctgcgtctagtttacagagtgatccccatcaagttcagcgcaggtgatcgtggcacgngtattcactctcacatcancagcctgacagcctaggtagtattttgacttaactttatactgtactaactaagtacttaacctacttacccgtcgggtaaccgttcgggtaaccgaaacggggaaccgtaaagggtaacggaaacttaaaccgaaaacgtaaccgtaggttacgggactacggacctactaacg

SEQ ID NO: 342717 - DNA, 513 bp, Homo sapiens
  misc_feature: GZ8MTXP02FE98E.4.74.G08.1.454.CMB.2.raw
  modified_base (195)..(195): a, c, t, g, unknown or other
  misc_feature (195)..(195): n is a, c, g, or t
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagagcactgtagcacgaccggtgctcgatttagtagctctatcaggggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaagctggtatcagcaagaaaccagggaaacgcccctaagctcctgatctacgctgcgtactagtttacngagtggagtccccatcaagtcagcgcngtgatcgtaggactaaagtactttcactctacaccatcagcagctagcagcctagaggtattttcgactaactttattactgtactacaagtactacacttaccgtgggtacttcggaccaaagggaccaaggtacgaaacncgaaacgaactggtcgctagacaacctntcg

SEQ ID NO: 342718 - DNA, 599 bp, Homo sapiens
  misc_feature: GZ8MTXP02GKREC.4.74.G08.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttgccgggnaagtcagacatcgaaatgaggtanctgtatcagacaagaaaccgagggaaacnccctaagctctgactctacgctgcgttacttagtttacagtagtcggacgtccccccatcgtaaggttcaggcggcagtggatcgtgacanagtattcactcacaccatcagcacgcctagcagccgtagacggttattttcgacttaaactttacttacgttagtactaactaaacgttactttaaccctacgtttaaccccgtaggggtacccggtttaccgggaaaccggtaaacggggaacccgtaaaaggggtaacggtaaaacgttaaaccgaaaaaccggtaacgttacgggtacgtacgtacggacctaaccttaaccgg

SEQ ID NO: 342719 - DNA, 717 bp, Homo sapiens
  misc_feature: GZ8MTXP02IG0LD.4.74.G08.1.454.CMB.2.raw
  modified_base (220)..(220): a, c, t, g, unknown or other
  misc_feature (220)..(220): n is a, c, g, or t
tcagagcactgtagcacgaccggtgctcgatttagtagctctatcagggggcaggagtcagacccactcaggacacagcatggacatgagggtcccccgctcagctcctggggctcctgctgctctggctcccaggtgccagatgtgccatccagatggcccagtctccaggttacctgtctgcgtatgtcggagacagagtcaccatcacttggccggnaagtcaggacagtacgaagtggagtagcgtagtacacgacgacgaacgaaaccggaagggaaaccccgtacccctaagccttcccgagtactaccgtacgtcgtacgttaccgttacgtttaagttaacgaaggtaggtacggaccgttaccccccagttaacgtaacggttcgaacggtccggacgtaggggtagacttcgacggacctacggaatttaccttacctacctcctaaccaccgtataccacgacgaccgccgtacgccgtaacgtccgtaggttacgtttaacgttttcgaacctttaaactttactttactacgtttaactaaacgttaaacttaaaccgtttaaccctaacccgttaaccggttacggggttaaacccggtttaccggaaaccggttaaaccggggaaaacggttaaacgggtaaacggttaaaactaaccgtaaaacgtacgtaacggtcgtacgtaccgaccgtaacttaccg

SEQ ID NO: 342720 - DNA, 693 bp, Homo sapiens
  misc_feature: GZ8MTXP02HQLT8.4.74.G08.1.454.CMB.2.raw
  modified_base (302)..(302): a, c, t, g, unknown or other
  misc_feature (302)..(302): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggccccagtctccaggttacctgtctgcgtatgtcggagacagagtccacatcacgttcggccggtacaagtcaggacactaccgaaaatggaaggtaagcgttaggatacgagacaaagaaaccgaagggaaaccgacccctaanccgtacctgaactcgtacgctgtacttactagtttaacaggtagtcggtacgtcccccaagtaccgtaaaggttaccgaggaccggagtagggtgggtaacttcggtacggactaacggtagttacttttacaaccttccttacgaacctacgtacacggacctaccgacgtacgacgacgtacgtacgtaggtttacgtttacgttaacttaactttaactttacgttacgttaactaactaacgttaacttaaccgttaaccgttaacccggttaccgggttaccggttaccgggtaaccggtaaaccggtaaacggtaaacggtaaacggtaaaacgtaaacgtaaaacggtaacgtacggtacggtacgtacgtaccgtaacgtacg

SEQ ID NO: 342721 - DNA, 555 bp, Homo sapiens
  misc_feature: GZ8MTXP02I64KZ.4.74.G08.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggccccagtcctccaggttacctgtctgcgtatgtcgganacagagtcacatcacttgccgggcaagtcaggacataccgaaatggaggtaagctggtatcagacaagaaaccgaaggaaacncccctaagctccngatctacgctgctactagttacagtagtggtactccccagtacaagttcaggcggcagggtgactcgtgacacgagttacttcacttcaccacatctagcagcctgcanccgtgtagtntttagacttaactttatactgtactaactaagtacttaaccgtacgttaacccggtcggtacgttaccgggaccgaaacgggtaaccgtaaggggtaacgtaactacgaaaacgtacgtagtacggtagtacgacgtacttacg

SEQ ID NO: 342722 - DNA, 506 bp, Homo sapiens
  misc_feature: GZ8MTXP02FINJ0.4.74.G08.1.454.CMB.2.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatcgaaatgaggtaagctggtancagcaagaaaccagggaaancccctaaagctcctgatctacgctgcgtctagtttacagagtggatccccatcaagtcagcggcngtggatcgtggcacagtatttcactcctcaccatcagcagcctgcagcctgacggtatttgactaacttatactgtactacaagattacacttacccgtgggacgttacggaccgtaaagggaacctaaggtacggaaaatacgaaaacgaatcgtcggctagacacta

SEQ ID NO: 342723 - DNA, 549 bp, Homo sapiens
  misc_feature: GZ8MTXP02F6DCE.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (247)..(248): a, c, t, g, unknown or other
  misc_feature (247)..(248): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (539)..(539): a, c, t, g, unknown or other
  misc_feature (539)..(539): n is a, c, g, or t
  modified_base (549)..(549): a, c, t, g, unknown or other
  misc_feature (549)..(549): n is a, c, g, or t
tcagagcactgtagcacgaccggtgctcgatttagtagctctatcagggggcaggagtcagacccactcaggacacagcatggacatgagggtccccgctcagctcctggggcctcctgctgctctggctcccaggtgccagatgtgccatccagatggcccagtctccaggttacctgtctgcgtatgtcgganacagagtcaccatcacgttgccggnaagtcaggacatacgaatgagtantgnnagacagaacgaggaacnccctanctcagatctacgntagcgtactagttacagagtacgacgtcccccagtacgtaaggttcaggcggtacaggtgacttcgcggactactagtactttaccgacttccgacacgatccgagcacgctgacacgtccgtagtaggtttctttagacttaacgtttattccgtatactaaacgtatactaccgtaccgttacccggtagggtaccgttcggaaacgaaacgggacttaaagggacgtaactaacgaacggtatggtacgacncgtacacgtn

SEQ ID NO: 342724 - DNA, 590 bp, Homo sapiens
  misc_feature: GZ8MTXP02J16GK.4.74.G08.1.454.CMB.2.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (353)..(354): a, c, t, g, unknown or other
  misc_feature (353)..(354): n is a, c, g, or t
  modified_base (390)..(390): a, c, t, g, unknown or other
  misc_feature (390)..(390): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatcggcccagtctccaggttacctgtctgcgtatggtcgganacagagtcaccatcacgttggccgggacaagtcaggactataccggaaatggaggtaancgtaggtancagacagaaaccgaggaaccnccctaanctctagntctacgntcgcttacttagttacaggacgtggactccccatacgaggtcagcgnnggtgtactcgtgacatagtcttaccactcaccactntacgagctacgccgtagacgacgtcgtaggtacgtttacgtttcaactttacgtttacttacgtacgttaacaaacgtaacgttacttaacctaccgttaccgtacgggtacccgttacggaaccggtaaaggaaccgtaagggtaaacgtaaaccgttaaacgaaaaccgtgttcggacgtacgtacgacctacgttcc

SEQ ID NO: 342725 - DNA, 563 bp, Homo sapiens
  misc_feature: GZ8MTXP02H8FBN.4.74.G08.1.454.CMB.2.raw
  modified_base (219)..(219): a, c, t, g, unknown or other
  misc_feature (219)..(219): n is a, c, g, or t
  modified_base (397)..(397): a, c, t, g, unknown or other
  misc_feature (397)..(397): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcacatcacttggccgggnaagtcaggacataccgaaaatggaggtaagcgtaggtatccgagacaaggaaaacccgaggggaaaaccgcccctaaaggcctcctagatctacgctgcgttcttaagttacaggtaagtggatccccatcgaagtcagcggcagtggatcgtgcacgatctacactctacactaacncagcacgcctcgacgtacgtacgtggtagttagtttactacttaactttacttacgtacttactaactaacttaacttactaccgttacgtacggtacgttacggaacgtaacggaacgtaacgtacgtaaactaacgaaacgtacgtagtcgacgtcactacacg

SEQ ID NO: 342726 - DNA, 571 bp, Homo sapiens
  misc_feature: GZ8MTXP02JPFLD.4.74.G08.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
tcagagcactgtagcacgaccggtgctcgatttagtagctctatcaggggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacgttgccggnaagtcaggacatacgaatggagtanctgtancagacaagaaaccgaggaacncccctaagctctagactctacgctggtcttactagttacgagtagtggactccccatcgtaagtcagcgacgngtgactcgngacaacagtacttcactctacactatcgagccacgcctgacgtacgcgtaggtacggttactttagactttaaactttacttaacttcgttacgtaaactaagttaccttaaccgaccgttaccgtcgggggtaccgtacggtacccggaaagggtaccgtaaagggtaacgaaacttaacgaaacggtaacgtcgggtacgtacacgtaccactacg

SEQ ID NO: 342727 - DNA, 636 bp, Homo sapiens
  misc_feature: GZ8MTXP02JG5N4.4.74.G08.1.454.CMB.2.raw
  modified_base (137)..(137): a, c, t, g, unknown or other
  misc_feature (137)..(137): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (358)..(358): a, c, t, g, unknown or other
  misc_feature (358)..(358): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtnccagatgtgccatccagatggcccagtctccaggttacctgtctgcgtatgtcggagacagagtcaccatcacgttgccgggacaagtcaggcatcgaaatgaggtaagctggtatcagcaagaaacgnggaaaccnccctaagcctctgactctacgctgtccgttataacgtttacagtacgtggtacgtcccccatacgtaaggttcaggtcggacgnggtgattcgtcggacacgtagtactttaccacttaccctacaacccatacccgtaacgacccacgtcccgtagaccgtacggtaccggttaggtaacggtttactttacgaacctttaaacgtttacttaccgtacttaaccgtaaactaacgttaccttaaccgtaccgttaacccggtacggggtacccggttacggaaaccggtaaacgggaaccggtaaaaggtacgtaaaacgtacgaaacgtacggtacggtacgtactcgacctaactacg

SEQ ID NO: 342728 - DNA, 679 bp, Homo sapiens
  misc_feature: GZ8MTXP02JHLCJ.4.74.G08.1.454.CMB.2.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (365)..(365): a, c, t, g, unknown or other
  misc_feature (365)..(365): n is a, c, g, or t
tcagagcactgtagcacgaccggtgctcgatttagtagctctatcagggggcaggagtcacacccactcaggacacagcatggacatgagggtcccccgctcagctcctggggctcctgctgctctggctcccaggtgccagatgtgccatccagatggcccagtcctccaggttacctgtctgcgtatggtcggagacagagtccaccatcacgttgccgggcaagtcaggacatccgaaatggaggtaagctagtancagacacgaaaccagggaaaccncccctaagctctgactcgtacgctgtacgttcttaaggttacaggtagtcggacgtcccccagtcgtaaggttcgacggcggnagggttgacttcgtacggcaacgtagttacctttaccactcctcctaaccacttaccgaacgtcccaccggtccgtacggccgtaacgtcccggtaggtaaaggggtttactttttacggaacgtttaaaccttttaacgttaacttaccggtaacgttaaactaaacgttactttaaccgttaaacccgttaacccggttaccggggtaccggttaccgggaaccggaaaacggggtaacccgtaaaggggtaacggtaaaaccgtaacgaaaaccggtaagttacggtacggccgttacgacctacttaacg

SEQ ID NO: 342729 - DNA, 535 bp, Homo sapiens
  misc_feature: GZ8MTXP02IZV39.4.74.G08.1.454.CMB.2.raw
  modified_base (194)..(194): a, c, t, g, unknown or other
  misc_feature (194)..(194): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (516)..(516): a, c, t, g, unknown or other
  misc_feature (516)..(516): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacttgccgggcaagtcaggacatccgaaatgaggtaanctggtancagcaagaaaccagggaaacncccctaagctcctgatctacgctgcgtctagttacagagtggactccccatcgaagtcagtcggcagtgatcgtggcacgagtactttcactctacacatcagcagcctgcagtcctagtaggttatttgacctaaagtttattactgttactaacgaaagtacttaactaccttaacccgttgggtaccgttcggaaccgtaaaggaccgtaaaggtacggaaaactacgaaaaccgtaangttacggctacgcaaccta

SEQ ID NO: 342730 - DNA, 550 bp, Homo sapiens
  misc_feature: GZ8MTXP02HT6RP.4.74.G08.1.454.CMB.2.raw
  modified_base (269)..(269): a, c, t, g, unknown or other
  misc_feature (269)..(269): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatcgaaatgagtaagctggtatcagcagaaaccaggaaancccctaagctcctgatctacgctgcgtctagtttacagtagtggagcccccaatcaaaggttcagcggcngtggatctggacacagactttcaacttcnaccaatccaanacacgcgtcgcacgacgtacgtagtagtttagtactaacttaattacttacgtactaactaacgtaattaactaacgttaaccgtacggtacggttacggtacgaacggaacggaacggtaacgtaaacgtaacgtaaacgtaacgtacgtacgtacgtacgtactactac

SEQ ID NO: 342731 - DNA, 541 bp, Homo sapiens
  misc_feature: GZ8MTXP02IMSDI.4.74.G08.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcgganacagagtcaccatcacttgccgggnaagtcaggacatacgaaatgaggtanctggtatcagcaagaaaccgaggaaacnccctaagctctgactcagctgcgtntagttacagtagtgactccccagtcaaggttcagcggctagggtgactcgtgacacgtagtactttcacttctacaccgatcagcagctgcagcctagaggttatttcgacttaattactacgttgtacctaagtaaactcttaactaccgttaccggtacgggtaccgttaccggaccggtaaacgggtacgtaaagggtaacgaactaacgaaacgtacgtgtacggctacgacacttag

SEQ ID NO: 342732 - DNA, 603 bp, Homo sapiens
  misc_feature: GZ8MTXP02F6PBI.4.74.G08.1.454.CMB.2.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (348)..(348): a, c, t, g, unknown or other
  misc_feature (348)..(348): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcaccatcacgttggccgggcaagtcaggacataccgaaatgaaggtaagctaggtatcgagacaagaaaccgagggaaacncccctaagctacctgatcacgctgtctactagttacagagtggactccccatccgagttcagcgcnggtgatcgtgacaacgtagtactttcgacttcctcaacatcacgccacgccgtgacgacgtccgtaggtacgtttagtttacgaactttaaactttacttaaccttcgtaacctaacgtaaagttaacttaacctaccgtttaacccggtcggggtaaccgttaccggaaccggtaaaagggtacccgtaaagggttaaacggaaacttaaccgaaaaacgtacgttaggtacggtacgtacgaccaacgtttcg

SEQ ID NO: 342733 - DNA, 605 bp, Homo sapiens
  misc_feature: GZ8MTXP02I302Y.4.74.G08.1.454.CMB.2.raw
  modified_base (194)..(194): a, c, t, g, unknown or other
  misc_feature (194)..(194): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcgganacagagtcacatcacttgccgggcaagtcaggacatacgaaatgaggtaagctggtatcagacaaagaaaccgaaggaaacgacccctaagcctacctagactcctacgctcgacgttacttagttacagagtggactccccatacgaagtcagcgcgngtggntcgtgacacagtctttacactctaccacatacatcacgacctgacagaccgttaggtaggttattttcggaacttaactttaactacttacgtactaacgtaaacgtactttaccgtaaccgtttaccggtacgggtaccgtttccgggaacgggtaaacgggtaaaccggtaagggtaaacggtaaaacgttaacccgtaaaaaggtaaccgttagggtacggaacgttacgactaaacttaccgg

SEQ ID NO: 342734 - DNA, 634 bp, Homo sapiens
  misc_feature: GZ8MTXP02JDFD1.4.74.G08.1.454.CMB.2.raw
  modified_base (221)..(221): a, c, t, g, unknown or other
  misc_feature (221)..(221): n is a, c, g, or t
  modified_base (351)..(351): a, c, t, g, unknown or other
  misc_feature (351)..(351): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttggccggganaagtcaggacataccgaaatgaaggtaagctggtatcagacaagaaaccgagggaaacgcccctaagcctctgatctacgctgcgtctagtttacagtagtcggatcccccataccgaagttcaggcgcnggtgactcgtaggcacgtagtactttaccactcctacacctatccgaagcctaacgcccgtgaccgtacgtacccgttagggtacggtttactttttacggaaccttaaactttttactttaccgttacggttaactaaaccgtaaagttaactttaaccgtaccgtttaacccggtacggggtacccggtttaccgggtaacccgaaacgggtaaccgtaaacgggttaacgaaaagttaaccgaaaacggtaacgtggtacggctacggacctaccgtacg

SEQ ID NO: 342735 - DNA, 579 bp, Homo sapiens
  misc_feature: GZ8MTXP02JXOJ6.4.74.G08.1.454.CMB.2.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
tcagagcactgtagcacgaccggtgctcgatttagtagctctatcagggggcaggagtcagacccactcaggacacagcatggacatgagggtccccgntcagctcctggggctcctgctgctctggctcccaggtgccagatgtgccatccagatggcccagtctccaggttacctgtctgcgtatgtcgganacagagtcaccatcacgttgcccggganaagtcaggacatccgaatgaggtaagctggtatcagacaacgaaaccgagggaaacncccctaagctcctgactcgtacgctgcgtctagttacagagtggactccccatcgtaaggtcaggtcggactagggtggaattccgaggaccacgtagtatttaccacctcctacaaccatccgagtcacgccgtgacacgtccgtaggaaggttacttttagaccttaactttattaccttgtaccgtaactaagtacttacctaccgtttaccgtcggggtacgttaccggaccgaaacgggaccgtaacggtacggaaactaacgaaacgtacgtacggtcgactacgcctacgtac

SEQ ID NO: 342736 - DNA, 565 bp, Homo sapiens
  misc_feature: GZ8MTXP02JLRMP.4.74.G08.1.454.CMB.2.raw
  modified_base (285)..(285): a, c, t, g, unknown or other
  misc_feature (285)..(285): n is a, c, g, or t
tcagagcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatggtcggagacagagtcaccatcacttggccgggacaagtcaggacataccgaaaatggaaggtaagctaggatcagacaaggaaaccgaggggaaacncccctaagcctcctagataccacgtctgtcgttactagtttaacaggtagtggactcccccagtacgtaagttcaggcggctagggtggtactcgtacgggacacgtagtactttcactctcacatacagcaagtcctagcagtcctagtacgttatttgacttaacttattacctgttaacacgtaaagtacttaccgtacgtaccgtagggtaccgtacggacgaaacggacgtaacggtagtaaactaacgaagtacgtcgagtactacgacaactg

SEQ ID NO: 342737 - DNA, 505 bp, Homo sapiens
  misc_feature: GZ8MTXP01DBJ6N.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggngagtcagggcattggctaatattagcctggtatcagcagagaccagggaaacctcctaacctcctgacttctttgctgcactccactctcgcaatcgacgggtcccaatctcgattcagtggcagtggatcgtgggactagtattcactctcaccatcagcagcctggcagcctgaatatgtgactaacttattactagtaacaaagaaattagacgcgtcgcccgccgttcgttacgtttcggacgggaacgggaccggaggttaggtaagaagtaaccg

SEQ ID NO: 342738 - DNA, 489 bp, Homo sapiens
  misc_feature: GZ8MTXP01DHC32.11.70.G04.1.454.CMB.2.raw
  modified_base (413)..(413): a, c, t, g, unknown or other
  misc_feature (413)..(413): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcagtcagggcattggcaatattagcctggtatcagcagagaccagggaaacctcctaacctcctgatctttgctgcatccactctcgcaaatcaggggtcccaatctcgattcagtgcagtgggatctgggacagattcactctcacatcagcagcctggcagcctgaagatgttgactaacttattacngttacaaaagtaattagcgctcgccccgacttcacggtttcggacggtaacgggaccaagggttgaagaagtaacg

SEQ ID NO: 342739 - DNA, 467 bp, Homo sapiens
  misc_feature: GZ8MTXP01B1DXZ.11.70.G04.1.454.CMB.2.raw
  modified_base (198)..(198): a, c, t, g, unknown or other
  misc_feature (198)..(198): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
tcagcgagagataccacgaccggtgctcgatttagtgtagtgtgaagggaaagggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcaatattagcctggtatcagcagagaccagggaaacctctaacctcctgatctttgctgcatccatctgcaatcagggtccaatctcgattcagtggcagtggatctgggacagatttcactctcaccatcagcagcctggcagcctgagatgtgcaacttntactgtcaaagattagcgctcgcccncgttcaggtttcggcggaagggaccagggttgaagngtaacg

SEQ ID NO: 342740 - DNA, 507 bp, Homo sapiens
  misc_feature: GZ8MTXP01DIWRG.11.70.G04.1.454.CMB.2.raw
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcaggcattggcaatattagcctggtatcagcagagaccagggaaacctcctaacctcctgatctttgctgcatccactctcgcaatcaggggtcccaatctcgattcagtggcagtggatctgggacagatttcactctcaccatcagcagcctggcagcctgaagatgttgacaacttattactgttcaaaagaattagtagcgttacgccccgcgttcgaacggttttcgggcgggtaacggggacccgaaagggttggaacgttaagtaaacccgg

SEQ ID NO: 342741 - DNA, 502 bp, Homo sapiens
  misc_feature: GZ8MTXP01AUNOL.11.70.G04.1.454.CMB.2.raw
  modified_base (224)..(224): a, c, t, g, unknown or other
  misc_feature (224)..(224): n is a, c, g, or t
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagcgagagataccacgaccggtgctcgatttagtgtagtgtgaagggaaaggggcagaagtctctctcagtcaggacagagcatggacatgagggtccctgctcagctcctgggactcctgctgctctggctcccagatgccagatgtgacatccagttgacccagtctccatcctccctgtctgcatctgtgggagacagagtcaccatcacttgccgggngagtcagggcattggcaatattagctgtatcagcagagaccagggaaacctcctaacctcctgatctttgctgcatccactctgcaatcgacgggtccaatctcgattcagtgcagtggatctgggacagattcactctcacatcagcagcctggctagcctagaagntaaagttgactaacttattactagttacaaaanattaagcgcgtacgtccccncgttcgttcggtttcgggcggaacgggacccgtaagggttcggaagaacgtaaaccg

SEQ ID NO: 342742 - DNA, 489 bp, Homo sapiens
  misc_feature: GZ8MTXP01BRSR2.11.70.G04.1.454.CMB.2.raw
  modified_base (224)..(224): a, c, t, g, unknown or other
  misc_feature (224)..(224): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggngagtcaggcattggcaatattagcctggtatcagcagagaccagggaacctctaacctcctgatctttgctgcatccactctcgcatcgacggggtcccaatctcgattcagtgcagtgatctggacagattcactctcacatcagcagcctggcagcctgaaagtntgtanactacttatactagaanaaagtattagcgcgtcgcccgttcgttcgttacggttcgggacgggaacggacgagggttagtaacgaacgtaacg

SEQ ID NO: 342743 - DNA, 504 bp, Homo sapiens
  misc_feature: GZ8MTXP01D96VQ.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggnagtcaggcatggcaatattagctgtatcagcagagaccagggaaacctcctaactcctgatctttgctgcatccactctcgcaatcgacgggtcccaatctcgattcagtgcagtgatcgtggacagattcactctcaccatcagcagcctggcagcctagagatgttgactaacttatactagtaacaaaagtaattagacgttctcgtaccccgcgttcgttacggtttccgggacgggtaacggggaccgaaaggggttcggaacgaacgtaaaccgg

SEQ ID NO: 342744 - DNA, 517 bp, Homo sapiens
  misc_feature: GZ8MTXP01CLXZR.11.70.G04.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatccctccctgtctgcatctggtggganacagagtcaccatcacttggccgggngagtcgagggcattggcaatatttagcctggtatcagcagagaccagggaaacctcctaacctcctgatctttgctgcactccactctcgcaatcgacggggtcccaattctcgattccagtggcaggtggatcgtgggacagtattcactctacaccatcagcacgcctggcagcctagaagntgtagactaacttatactagtacaaaagtanagcgcgtacgccccgacgttcgacggtttcgggcgggtaacgggaccgaagggttaggaacgaacgtaaaccgg

SEQ ID NO: 342745 - DNA, 510 bp, Homo sapiens
  misc_feature: GZ8MTXP01EB06W.11.70.G04.1.454.CMB.2.raw
  modified_base (200)..(200): a, c, t, g, unknown or other
  misc_feature (200)..(200): n is a, c, g, or t
  modified_base (395)..(395): a, c, t, g, unknown or other
  misc_feature (395)..(395): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcgagggcattggcaatattagcctggtatcagcagagaccaggaaacctctaacctctgatctttgctgcatccactctcgcaatcagggtcccaatctcgattcagtggcagtggatcgtgggactagatttcactctcacatcagcagcctgcagcctagaagntgtgactaattatactgtaactaaaagaattacgcgcgtacgtccccgcgttcgttacggtttccgggacgggtaacgggaacccgaagggttacgggaagttaacgtaaaccgg

SEQ ID NO: 342746 - DNA, 479 bp, Homo sapiens
  misc_feature: GZ8MTXP01BYTXH.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggngagtcagggcatggcaatattagcctggtatcagcagagaccagggaacctctaacctcctgatctttgctgcatccactctcgcatcacgggtcccaatctcgatcagtgcagtgatctggacagattcactctcacatcagcagctgggcagcctgaantgtgactaacttatactgtacaaagattagcncgtcgcccgcttcgacggtttcgggcggtaagggaccgagggttaggtaacgaagtaaaccg

SEQ ID NO: 342747 - DNA, 499 bp, Homo sapiens
  misc_feature: GZ8MTXP01A567S.11.70.G04.1.454.CMB.2.raw
  modified_base (199)..(199): a, c, t, g, unknown or other
  misc_feature (199)..(199): n is a, c, g, or t
  modified_base (334)..(334): a, c, t, g, unknown or other
  misc_feature (334)..(334): n is a, c, g, or t
  modified_base (432)..(432): a, c, t, g, unknown or other
  misc_feature (432)..(432): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcgagggcattggcaatatttagcctggtatcagcagagaccagggaaacctcctaacctcctgatctttgcttgcatccactctcgcaatcgacgggtcccaatcncgattcagtgcagtgatctgggacagtattcactctacaccatccagcagcctgggcagccagagatgtgactattatactgtacaaaagattagacncgtacgcccgttcgttcgttacgttcgggacgggtaagggaaccgtagggttcgaagaacgtaaccg

SEQ ID NO: 342748 - DNA, 505 bp, Homo sapiens
  misc_feature: GZ8MTXP01CABBE.11.70.G04.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (354)..(354): a, c, t, g, unknown or other
  misc_feature (354)..(354): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggnagtcagggcattggcaatattagcctggtatcagcagagaccagggaaacctccgtaacctcctgtatctttagctgcatccactctgcaatcaggggtcccaatctcgatcagtgcagtgatctgganagattcactctcacatcagcagcctggcagcctagaacgatgttgactaacttatacctgtaacaaaagtaattagacgcgtacgccccttacgttcgttacggtttcggcgggtaaggaccgaagggttacggaagaagttaaaacccgg

SEQ ID NO: 342749 - DNA, 501 bp, Homo sapiens
  misc_feature: GZ8MTXP01EEXQM.11.70.G04.1.454.CMB.2.raw
  modified_base (225)..(225): a, c, t, g, unknown or other
  misc_feature (225)..(225): n is a, c, g, or t
  modified_base (398)..(398): a, c, t, g, unknown or other
  misc_feature (398)..(398): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggngagtcagggcattggcaatattagcctggtatcagcagagaccagggaaaccctcctaacctcctgatctttgctgcatccactctcgcaatcgacgggtcccaatctcgattcagtgcaggtgatcgtgggacagatttcactctcacatcagcagcctgggcagcctaganatgttgactaattattactagtacaaaagattagcncgtacgccccncgttcgttacggtttcgggacggtaacgggaccgagggttcggaagaagtaaaccg

SEQ ID NO: 342750 - DNA, 493 bp, Homo sapiens
  misc_feature: GZ8MTXP01EL5ZD.11.70.G04.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagatcacatcacttgccggnagtcaggcatggcaatattagctggtatcagcagagaccagggaaacctcctaacctcctagacttctttgctgcactccactctgcaatcgacgggtcccaatctcgattcgagtggcaggtgggactcgtgggacagtattcacttctcacatcagcagcctggcagcctagaagatgttnactaacttatactgtaacaaaagattagcgactcgcccngttcgaggttcgggagggaacgggtaccgagggttgaagaacgtaaacg

SEQ ID NO: 342751 - DNA, 515 bp, Homo sapiens
  misc_feature: GZ8MTXP01D6XL5.11.70.G04.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtctccatcctccctgtctgcatctgtggganacagagtcaccatcacttggccgggngagtcgagggcattggcaatattagcctggtatcagcagagaaccagggaaaccctcctaacctcctgatctttgctgcactccactctcgacaatcgacggggtcccaagtctcgtattcagttggctaggtgatcgtagggacagtattcactctacactancagcagcctgcagctagaagatggtnactaattattactagaacaaaagaattagcgcgtacgcccgttcgttcttacggtttcgggacgtaacgggaccgaagggttaggaagaacgtaaaccg

SEQ ID NO: 342752 - DNA, 515 bp, Homo sapiens
  misc_feature: GZ8MTXP01BFAZY.11.70.G04.1.454.CMB.2.raw
  modified_base (199)..(199): a, c, t, g, unknown or other
  misc_feature (199)..(199): n is a, c, g, or t
  modified_base (354)..(354): a, c, t, g, unknown or other
  misc_feature (354)..(354): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatccctccctgtctgcatctgtggganacagagtcaccatcacttggccgggcagtcagggcattggacaatattagcctggtaatcagcagagaaccagggaaaccctctaacctctgatctttgctgcatccactctcgcaatcgaggggtcccaatctgatcgagtggcaggtgatcgngggacagtattcactctcactactcacgcacgtcctgggcacgtcctagaagtatcgtagacctaattatactagtaacaaagattacgcgttcgacgcccgttcgttcgttacggtttcggacgggaacggaccggaaggttcggaagaacgtaaaccgg

SEQ ID NO: 342753 - DNA, 555 bp, Homo sapiens
  misc_feature: GZ8MTXP01EB4A5.11.70.G04.1.454.CMB.2.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatccctccctgtctgcatctggtggganacagatcaccatcacgttggccgggngagtcgagggcagttggactaaattattagcctggtatcagcagacgaaccagggaaacctcctaacctctgattctttgctcgctactccactctcgactaagtcgacgggtcccaatctcgatcagtgctaggtgtatcgtaggactagtattcactctacacactcaacgcacgcctaggacagtcctagaagtgttagttacgaactaatttaacttactaagtaacaaaagtacttagcgttcgtccgcccttcgttcgttacgggtttcgggaccggaacgggtaccggaagggttacggaacgttaacgtaaacccgg

SEQ ID NO: 342754 - DNA, 515 bp, Homo sapiens
  misc_feature: GZ8MTXP01EI5AH.11.70.G04.1.454.CMB.2.raw
  modified_base (200)..(200): a, c, t, g, unknown or other
  misc_feature (200)..(200): n is a, c, g, or t
  modified_base (413)..(413): a, c, t, g, unknown or other
  misc_feature (413)..(413): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcaggcatggcaatattagctggtatcagcagagaccagggaaacctcctaacctcctgatctttgctgcatccactctcgcaaatcgacggggtcccaatctcgattcgagtggcaggtgatcgtgggacagtattcactctactaccatcacgcagcctggctacgcctagaagtatcggttnactaaacttattaactgtaacaaaagattaagcgctcgcccgcgttcgttacggtttcgggacgggaacgggaccgaagggttaggaacgaacgtaaaccgg

SEQ ID NO: 342755 - DNA, 494 bp, Homo sapiens
  misc_feature: GZ8MTXP01B7O7O.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (393)..(393): a, c, t, g, unknown or other
  misc_feature (393)..(393): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggnagtcagggcattggctaatattagcctggtatcagcagagaccagggaaacctctaacctcctgatctttgctgcatccactctgcaatcgagggtcccaattctgattcagtgcagtgatcgtggacagtatttcactctcacatcagcagcctggcagcctagaacngtgtagactaacttattactagtaacaaaagattagcacgtcgcccgcgttcgacggtttcgggacggtaacgggtaccgaagggttgaacgaagtaaccg

SEQ ID NO: 342756 - DNA, 513 bp, Homo sapiens
  misc_feature: GZ8MTXP01A5DQN.11.70.G04.1.454.CMB.2.raw
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagatcacatcacttggccgggcgagtcgagggcagttggctaatattagcctggtatcagcagagaaccagggaaacctcctaacctcctgatctttgctgcatccactctcgcaatcgacggggtcccaatctcgattcagtgctagtgatcgtgggactagtattcactctcacatcagcagcctgggcagcctagaatntggtanactaacttattactagtaacaaaagaattagcgacgtcgccccttcgttcacgggtttcgggcgggtaacgggaccgagggttaggaacgttaagtaaaccgg

SEQ ID NO: 342757 - DNA, 605 bp, Homo sapiens
  misc_feature: GZ8MTXP01DVSKZ.11.70.G04.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (414)..(414): a, c, t, g, unknown or other
  misc_feature (414)..(414): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatcctccctgtctgcatctgtggganacagatcaccatcacgttggccgggngagtcgagggcagttggactaatattagcctggtatcagcaagacgaaccgaacgggtaaaccctcctaaacctcctagtacttctttgctcgctaactccactctacgactaaacgtcgtaacgggtcccaattctcgtattcgaggttgcgtagtgatcgtagggatagtatttcactactcaaccanacgacgcacgccgtacggacacgtacgtaagtaacgtgttagtactaacttaaactttaattaacgtaacgtaaacgtaaaagtaaacgttacgtaccgttaccgtaccgtcccgttaccgttcggttacgggttaacgggtacgggtaacgggtaacggtaacgggttaacggtaacggttaacgtaacg

SEQ ID NO: 342758 - DNA, 629 bp, Homo sapiens
  misc_feature: GZ8MTXP01DUO7R.11.70.G04.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatcgtgtggganacagagtcaccatcacgttgccgggnaggtcgagggcattggactaattattagccttggtatcagcagagaaccagggaaacctcctaacctcctagtactctttgctgctactccactctcgcaaagtcgtacggggtccctaaattcctcgtacttccgaaggttcggaccgtaggtcggtagttccgtaggggaactaaggtactttcaaccttactaccaacctactacaacgccaacgcccttcggacaacggtccgtaaggaaacgttagtgtttacgtaacttaactttaatttactaacgtaanaaaaagtaanaacgtccgttacgtcccgtcccggttacgttccggttacgggttttccggggacgggtaacgggtaaccggagggttacgggtaagttaacgttaaaaccggg

SEQ ID NO: 342759 - DNA, 493 bp, Homo sapiens
  misc_feature: GZ8MTXP01AQIAR.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (486)..(486): a, c, t, g, unknown or other
  misc_feature (486)..(486): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggnagtcagggcattggcaatattagcctggtatcagcagagaccagggaaacctcctaacctctgatctttgctgcatccactctcgcaatcgagggtcccaatctcgattcagtgcagtgatcgtggacagtatttcactctcaccatcagcagcctggcagcctagacgatgttgactaacttattactgttacaaaagtattagcacgtcgcccgttcgttcttacggtttcgggacggaagggaccgagggttggaacgngtaaccg

SEQ ID NO: 342760 - DNA, 461 bp, Homo sapiens
  misc_feature: GZ8MTXP01D8WET.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (361)..(362): a, c, t, g, unknown or other
  misc_feature (361)..(362): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagcgagagataccacgaccggtgctcgatttagtgtagtgtgaagggaaaggggcagaagtctctctcagtcaggacacagcatggacatggagggtccctgctcagctcctgggactcctgctgctctggctcccagatgccagatgtgacatccagttgacccagtctccatcctcctgtctgcatctgtggganacagagtcaccatcacttgccggnagtcaggcatggnatnttagctggtatcagcagagaccagggaaacctcctaacctcctgatctttgctgcatcactctcgcatcagggtcccaatctcgattcagtgcagtggatcgtggacagattcactctcacnncagcagcctggcagctgaagatgtnctacttatactgactaaagnttaggcnctcgcccgnttcaggtttcggcggaacggacagggngaagttnaacg

SEQ ID NO: 342761 - DNA, 516 bp, Homo sapiens
  misc_feature: GZ8MTXP01CYE5M.11.70.G04.1.454.CMB.2.raw
  modified_base (201)..(201): a, c, t, g, unknown or other
  misc_feature (201)..(201): n is a, c, g, or t
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatccctccctgtctgcatctggtggganacagagtcaccatcacgttggccgggcgagtcgagggcatggctaatattagcctggtatcagcagagacaggaacctcaactcctgatctttgctgcactccactctcgacaatcgacggggtcccaaatctcgattccagttgcngtgatcgtgggacagtatttcaactctccacatcaagcagtcctggggacaggcctagaagtntgtagtactaaacttatacctagtaaaanaaagattacgcgccgtcgcccttcgttcgttacggttcggacgggtaacggacgaggttacgtaacgaacgtaacg

SEQ ID NO: 342762 - DNA, 658 bp, Homo sapiens
  misc_feature: GZ8MTXP01A5TON.11.70.G04.1.454.CMB.2.raw
  modified_base (226)..(226): a, c, t, g, unknown or other
  misc_feature (226)..(226): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacgttgccgggngagtcgagggcagttggactaatattagctggtatcagacagacgaccgaacggaaacctcctaacctctagtacttctttgctgactactcctactctacgctaagtccgacgggtccctaattccgtcgtattcgagtcggacgtaggtcgactcgtagggtactaggtactttacacttacctacacctatcaacgcctaacgtcccgtaggacgaacgtcccgtaaggtaacgtaacgttcgggttagtaaccctttaaactttaacgtttaaacgttaaccgttaaacgtaaaaaaggtaaacttaccggggtaccttaacccgtttccggcccccgttaccgttcggttaccggggttttaacccggggacggggtaaccgggtaaccggtaaggggttaccgggtaaggttaacgtaaacccggg

SEQ ID NO: 342763 - DNA, 572 bp, Homo sapiens
  misc_feature: GZ8MTXP01A9455.11.70.G04.1.454.CMB.2.raw
  modified_base (198)..(198): a, c, t, g, unknown or other
  misc_feature (198)..(198): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacttgccgggcagtcagggcattggacaatattagcctggtatcagcagagaccagggaaacctcctaacctcctgacttctttgctgcactccactctcgcaatcgacggggtcccaatctcgattcagtgcaggtgatcgngggtacagtacttcactctcacatcacgcacgtcgngcgacgctaggaagtgttgtactacttaactttacgttaactacgttaaagaaaagtaacgttacggtccgttaccgtccggtaccccgttcgttacggtttaccggggttaaccggggtaccggggaaccggggttaaacccggacggggttaagggaacggttaacgtaaaaacccggg

SEQ ID NO: 342764 - DNA, 490 bp, Homo sapiens
  misc_feature: GZ8MTXP01DM4Z7.11.70.G04.1.454.CMB.2.raw
  modified_base (200)..(200): a, c, t, g, unknown or other
  misc_feature (200)..(200): n is a, c, g, or t
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcacatcacttgccgggcgagtcgagggcattggctaatattagcctggtatcagcagagaccagggaaacctcctaacctctgatctttgctgcatccactctcgacaatcgacggggtcccaatctcgatcagtgcagtgatcgtggacngattcactctcacatcagcagcctggcagccagantgtgactacttatactgtacaaaagattagcgcgtacgccccgcttcgttacgtttcgggacggtaagggaccgaagggttggaagaacgtaaaccg

SEQ ID NO: 342765 - DNA, 498 bp, Homo sapiens
  misc_feature: GZ8MTXP01CIDR8.11.70.G04.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatcctccctgtctgcatctgtggganacagagtcacatcacttggccgggnagtcgagggcagttggactaatattagcctggtaatcagcagagaccagggaaacctcctaactcctgactctttgctgcatccactctcgacaagtcgacgggtccaatctcgattcagtgcagtgatcgtggacagtattcatctacacatcacgcagccctgggcacgcctagaagtatgtgtactaattatactagacaaaanangacncgtacgcccttcgngttacggttcggagggtaacggacctagggttcgtaagaacgtaaacg

SEQ ID NO: 342766 - DNA, 520 bp, Homo sapiens
  misc_feature: GZ8MTXP01C6JBT.11.70.G04.1.454.CMB.2.raw
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatctggtgggagacagagtcaccatcacttggccgggngagtcgaggcattggacaattattagcctggtatcagcagagaaccgacgggaaacctcctaacctctgactctttgctgcactccactctcgactaatcgacgggtcccaattcctcgattcgaggtgcaggtgatcgtggacagtatttcactctacacatcagcacgcctggcacgcctagaacgtntgttgactaacttattactagtaanaaaagaattagcncgtcgcccttcgttcgttacggtttcgggacggtaagggaccgaggttaggaagaagtaaccg

SEQ ID NO: 342767 - DNA, 505 bp, Homo sapiens
  misc_feature: GZ8MTXP01DABGO.11.70.G04.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggngagtcgagggcattggcaatattagctggtatcagcagagaccaggaacctcctaacctctgatctttgctgcatccactctcgcaatcgacgggtcccaatctcgattcagtgcagtgatcgtgggacagtattcactctcaccatcagcacgcctgcagacctagagtatgtntacctaattatactntaaacaaaagattaagcgacgttcgcccgttacgttcgttacggtttcgggacggaacgggaccgagggttaggaacgaacgtaaaccgg

SEQ ID NO: 342768 - DNA, 555 bp, Homo sapiens
  misc_feature: GZ8MTXP01D94YJ.11.70.G04.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (383)..(383): a, c, t, g, unknown or other
  misc_feature (383)..(383): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggngagtcagggcagttggactaatattagcctggtatcagcagagaccaggaaacctcctaacctcctgatctttgctgctatccactctcgcaatcgagggtcccaatctgattcagtgcaggtgatcgtagggactagtatttcacttctcacctancagcacgcctggcacgcctagaagtgttcgtacgtaacttaaactttaattaactaagtaaactaaaagtaacgttacgtccgttacgtccgtaccccgttcgttaccggttacgggtttaaccgggacgggtaacgggaaccgtaaggggttacggaacgttaacgtaacg

SEQ ID NO: 342769 - DNA, 443 bp, Homo sapiens
  misc_feature: GZ8MTXP01EKBGL.11.70.G04.1.454.CMB.2.raw
  modified_base (434)..(443): a, c, t, g, unknown or other
  misc_feature (434)..(443): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctcactacggtatggacgtctggggccaagggaccacggtcaccgtctcctcagcctcaccaagggcccatcggtcttccccctggcacccctcctccaagagcacctcgtgggggcacagcggccccctgggctgcctggtcaagggctacttccgtatctctcgctgagcgggctggcaaggcgcatagnnnnnnnnnn

SEQ ID NO: 342770 - DNA, 510 bp, Homo sapiens
  misc_feature: GZ8MTXP01BRXQS.11.70.G04.1.454.CMB.2.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcgagggcattggcaatattagcctggtatcagcagagaaccagggaaacctcctaacctctgatctttnctgcatccactctcgcaatcgacggggtcccaaatctcgattcagtgcagtgatcgtgggacagatttcactctcacatcagcagcctggcagcctagaagatgttgactaacttattactgtaacaaaagtaattagacgcttaccgccccgttcgttcgttacggtttcgggcgggaacgggacccgagggttacggaagaataaaccgg

SEQ ID NO: 342771 - DNA, 512 bp, Homo sapiens
  misc_feature: GZ8MTXP01ECRVK.11.70.G04.1.454.CMB.2.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatccctccctgtctgcatctgtggganacagagtcaccatcacttggccgggcagtcgagggcattggctaattattagccttggtatcagcagagaccaggaacctctaacctctgtattctttagctgcactccactctcgactaaagtcgacgggtcccaattctcgtattcgagtggctagtggatcgtggactagtatttcacttctacacatcancagcctggcagcctagaagctgtnactaacttatactagtaacaaaagtattagcgcgtcgcccgcgttcgacggtttcgggacggaacgggaccgagggttagaagaacgtaaccg

SEQ ID NO: 342772 - DNA, 573 bp, Homo sapiens
  misc_feature: GZ8MTXP01DTU2B.11.70.G04.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (455)..(455): a, c, t, g, unknown or other
  misc_feature (455)..(455): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtcctccatccctcctgtctgcatcgtggtggganacagagtcaccatcacgttcggccgggnaggtcgagggcagttggactaattattagccttggtatcagcaagacgaaccgaacgggtaaaccctaccgtaacctccgtagtacttctttgctgctactccactctacgactaaagtcgacgggtcccaaattctcggtactcgaggttcgacgtaggtgactcgtacgggactagtacttcactactacactatcacgcacgcctggacacgctagaagtntgtactaactacttaatactagaaacaaaatagttacgcgttcgtaccgtcccttcgttcgttacgggttaacgggacggaacgggacgtagggttacggaagttaacgtaaaaccgg

SEQ ID NO: 342773 - DNA, 520 bp, Homo sapiens
  misc_feature: GZ8MTXP01BHO40.11.70.G04.1.454.CMB.2.raw
  modified_base (421)..(421): a, c, t, g, unknown or other
  misc_feature (421)..(421): n is a, c, g, or t
  modified_base (466)..(466): a, c, t, g, unknown or other
  misc_feature (466)..(466): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatcctccctgtctgcatctggtgggagacagagtcacatcacttggccgggcgagtcgagggcagttggctaatatttagccttggtatcagcagacgaccaagggaaacctcctaacctcctagattcttgctgcatccactctcgactaatcgacgggtccctaatctcgattcgagtcggacgagtggatcgtgggacagtattcacttctacacatcagcagcctggcaacggcctaggaacgtntgtgactaattatactagtaacaaaggtattagcgctcggccccngttcttacggttcggacgggtaacgggaccgtagggacgaagttaacgtaaccg

SEQ ID NO: 342774 - DNA, 565 bp, Homo sapiens
  misc_feature: GZ8MTXP01DD34V.11.70.G04.1.454.CMB.2.raw
  modified_base (201)..(201): a, c, t, g, unknown or other
  misc_feature (201)..(201): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagatcaccatcacgttggccgggcgagtcgagggcattggctaatattagcctggtatcagcagagaccagggaaaccctcctaacctctgatctttgctgcactccactctcgcaatcgacggggtcccaatctcgattccgagtggcagtggatcgtggacagtactttacactctcacctatcagcacgtcctggcagacctagaacgtagttgttcgaaccttaaactttacttaaccgttagtaaactaaaaaacgtaagttaacggtccgcgtaccggtccccgttacgttccgttaacgggtttccggggaacgggaacgggtaaccggaggggttaggaacgaacgtaaaccgg

SEQ ID NO: 342775 - DNA, 601 bp, Homo sapiens
  misc_feature: GZ8MTXP01DH299.11.70.G04.1.454.CMB.2.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttcgacccagtctccatccctcctgtctgcatctggtgganacagacgtcacatcacgttggccgggngagtcgaagggcagttggactaaattattaagccttaggtactacagacagacgaaccgaacggaaaccctacctaacctcctagtacttctttgctcgacactccactctcactaatcgacggtccaatctcgattcagtcgcgtagtgatcgaggacagtacttcactactacactancacgaccncgcgcgcgacgacgtagtagtagtacgttacgtaacttaactttaactttaacgttaaacgtaaacgtaaaacgtaaacgttacgtaccgttaccgtacccgtacccgttaccgttccggttacgggttaaccgggtacgggtaacggggtaacggtaacgggttaacggtaacggttaacgtaacg

SEQ ID NO: 342776 - DNA, 518 bp, Homo sapiens
  misc_feature: GZ8MTXP01DT29L.11.70.G04.1.454.CMB.2.raw
  modified_base (225)..(225): a, c, t, g, unknown or other
  misc_feature (225)..(225): n is a, c, g, or t
  modified_base (427)..(427): a, c, t, g, unknown or other
  misc_feature (427)..(427): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttggccgggngagtcagggcagttggactaatattagcctggtatcagcagagaccaagggaaacctcctaaaccgtcctagattctttgctgcactccatctgacaagtcgaacgggtcccaaatctcgattcagtgcagtggatcgtagggactagtactttcaacttctcaccataccaagcagcctgggactagcctagaagtatgtnacttaattatatagtaacaaaanaanagcgcgtccgccgttcgttcgttacggtaacggacggaacggacggaggaggtaagaacgtaacg

SEQ ID NO: 342777 - DNA, 674 bp, Homo sapiens
  misc_feature: GZ8MTXP01D5K7F.11.70.G04.1.454.CMB.2.raw
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgaccagtctccatcctccctgtctgcatctgtgggagacagagtcaccatcacgttggccgggcgagtcgagggcagttggactaaattattagccttggtaatcagcagagaaccgaacgggaaaccctcctaaacctcctagtacttctttgctgcacttcccgacttctacgaccaaagtccgaacggggtcccctaaatccttcggatttccgaaggttcggacgtagggttagggacttcgtaggggactaaggtatttccacttctaccaactactaccaacgcgaacgtccccgttagggacctacggtacctaaggtaagtagtttaggtttacgtaaaccttaaacttttaacgttaaccttaagtaaaccgtaaaaaaggttaattacggtacccgttacgttacccggtcccccgttagttccgttaccggggttttccgggaccgggggtaacgggtaaccggaagggggttacggtaaagttaaccggttaaaaccgg

SEQ ID NO: 342778 - DNA, 549 bp, Homo sapiens
  misc_feature: GZ8MTXP01A0T3M.11.70.G04.1.454.CMB.2.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctggtgggagacagagtcaccatcacgttggccgggngagtcgagggcagttggctaatatttagcctggtatcagcagagaccagggaaacctcctaactcngatctttnctgctatccactctcgacatcgacggggtcccatctcgatcagtgcagtgatcgtggganagtattcactactcaccatcagcagcctgcagcctagaagtntgttgactaacttacttaactgtaaaccgtaaaaagtaagttacgaccgttccgttccgaccccgttcgttccgttacgggttttaaccgggacgggttaacggggacccgaaaggggttacggtaacggaacgttaaacccggg

SEQ ID NO: 342779 - DNA, 618 bp, Homo sapiens
  misc_feature: GZ8MTXP01CX008.11.70.G04.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcacatcacgttggccgggnagtcagggcattggctaatattagcctggtatcagcagagaccgagggaaacctccaacctctgacttctttgctgctactccactctcgactaagtcgacgggtcccaatctcgattcgagtggctaggtgactgtaggactagtactttcactcctacaccatcgagtcaacgtcccgtggaccacggtacctaggtaaacgtagttcgggttacgtaaaccgtttaaacgttttaaacttaaccgttaacgttaaaccgtaaaaaagtaacgttaaacggtccgttaccgttaccgtccccgttaacgtttcccggttaacgggtttaaccggggacgggtaacggggaacccggtaaggggttagaacggttaacgttaaaaccggg

SEQ ID NO: 342780 - DNA, 632 bp, Homo sapiens
  misc_feature: GZ8MTXP01CF82Z.11.70.G04.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagcgagagataccacgaccggtgctcgatttagtgtagtgtgaagggaaaggggcagaagtctctctcagtcaggacacagcatggacatggagggtccctgctcagctcctgggactcctgctgctctggctcccagatgccagatgtgacatccagttcgacccagtctccatccctccctgtctgcatctggtggganacagacgtcaacatcacgttggccgggngagtcgagggcagttggctaaattattagtcctaggtatcagcagagaccaaggtaaacctcctaactcctgacttctttgctgcactccactctacgcaaatcgacgggtcccaattctcgatttcgaggttcggacaggtagatcgtagggtaacgatactttcactcttacaaccactcaagccgaacgtcctacggacgacgttacccgtaaggaacggtaacttggttacgtaacccttaaaattttaaacgttaacccttaaggtaaacctaaaaaaacgggttaaacgttaccggtaccgccgtacccgtacccgttacgttccggttaccgggttaaccggggaacgggtaacgggtaacggtaagggttacggtaaacgttaacgtaaaccg

SEQ ID NO: 342781 - DNA, 599 bp, Homo sapiens
  misc_feature: GZ8MTXP01AOAYG.11.70.G04.1.454.CMB.2.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatcctccctgtctgcatctggtggganacagagtcaaccatcacgttcggccgggngagtcgagggcagttggacaattattagcctggtatcagcagagaaccacgggaaaccctccgtaacctcctgtactctttgctgctactccactctcgactagtcgacgggtcctaactctcgattcagtgcnggtgatcgtgggacagtatttcactctacactancagcacgcctacggctacgccttagaaagtgtaggttacgtaacttaaactttagttaacctaggttaaaccaaaaaacggtaagttaacggaccgttacccgttccggacccccgttcgttacggttacgggttttaaccggggaccgggtaacggggtaacccggaagggttacgggtaacgttaacgtaaaccggg

SEQ ID NO: 342782 - DNA, 524 bp, Homo sapiens
  misc_feature: GZ8MTXP01AYP37.11.70.G04.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggnagtcagggcagttggctaatattagccttggtatcagcagacgaccaggaaacctctaacctctgattcttgctgcatccatctcgacaagtcgacgggtcccaatctcgatcagtgcagtgatcgtagggacaggtatttcacttctacacatcacgtcagcctgcagcctagaatctgtgtaacctaactttataacgttacgtaacaaaagtagttagcgttacgtccgtcccgacgttcggttaacggttcgggacgggtaaggaaccgtagggttagaacgttaacgtaaacgg

SEQ ID NO: 342783 - DNA, 508 bp, Homo sapiens
  misc_feature: GZ8MTXP01EAQWG.11.70.G04.1.454.CMB.2.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcacatcacttgcgggcagtcagggcatggcaatattagcctggtatcagcagagaccaggaaacctctaacctctagattctttgctgcatccactctcgcaatcgacgggtcccaatctcgattcagtgcagtgatcgtggacagtattcactctcacntcagcagctagcngcctagangtgtgactaacttatactagaacgaaaagaacttagcgcgttaccgccccttcgttcgttacggtttccgggacgggtaacggggacccggtaagggttcggaacgttaagtaaacccgg

SEQ ID NO: 342784 - DNA, 693 bp, Homo sapiens
  misc_feature: GZ8MTXP01E0AGZ.11.70.G04.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatccctccctgtctgcatctggtggganacagagtcaccatcacgttggccgggngagtcgagggcagttggactaattattagcctggtatcagcgaagacgaaccgaacgggtaaaccctccgtaaacctcctagtacttctttgctgctactccactctcgactaactcgacgggtccctaaattctcgtactcgaggtcggcgtaggtcgggtactcgttgggaactacggttactttaccgacttacctacctaacctacgttacgaaacggccaaacgtcccgttacgggaccgtaacgtaacccgttaggtaaaccgttagttcgggtttaacgtaacctttaaacttttaacggtttaaacttaacgggttaaacctaaaaaaggtaacgtttaaacgggccgttaccgttacccggaccccggttacgttccgggttacgggttttcccgggggacgggttaacggggaacccgtagggggttacggaacgttaacggttaaaccggg

SEQ ID NO: 342785 - DNA, 500 bp, Homo sapiens
  misc_feature: GZ8MTXP01EL6DM.11.70.G04.1.454.CMB.2.raw
  modified_base (198)..(198): a, c, t, g, unknown or other
  misc_feature (198)..(198): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacttggccgggcagtcgaggcattggactaatattagctggtatcagcagagaccaggaaacctcctaaacctctagattctttgctgctacttccactctcgactaatcgacgggtcccaatctcgtatttcgagtggacagtggatcgngggacagtacttcactctcacntcngcagcctggcagcctaganagtgtcactacttatactgtaaacaaagaattanacgcgtcgccgcgttcgttacggtcggtcggaacggacgaggttagtaacgaagtaacg

SEQ ID NO: 342786 - DNA, 550 bp, Homo sapiens
  misc_feature: GZ8MTXP01EW1J2.11.70.G04.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagatcaccatcacgttgccggngagtcgagggcagttggactaatattagccttggtatcagcagagaccaagggaacctcctaactctgatctttgcttgcactccatctacgctaatcgacgggtcccaaagttcctcgagtttcgaggtcggacgtaggtcgatcgtaggactagtattcactctacacatcgacgcacgctaacgcgccgtagacgtatgttacgactaaacctttatacctagtaaacaaaggtaaattaacgcgcttccggacccgtcttcgttcgggttcgggaacgggtacgggaacgaagggtacggagtaacgttaacgaaaacggg

SEQ ID NO: 342787 - DNA, 682 bp, Homo sapiens
  misc_feature: GZ8MTXP01B79QM.11.70.G04.1.454.CMB.2.raw
  modified_base (203)..(203): a, c, t, g, unknown or other
  misc_feature (203)..(203): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgctatctgtggganacagacgtcacatcacgttcgcgggcgagtcgagggtctagttggactaagttagttacgccttaggtactcgagacgaagaacgaaccgtaaacgggtaaacccctcctaaaccctcctagtacttcgtttagctagcctactcctactcgtacgactagtccgtaacgggtccctaatcgtaacgtatttccggagtcgacgtagggtcgatcgtaggaactagtcttacacctacacctacctacgtaccacgtaccacgtccccgttgggacccgtaacggtccgttaacgggaagtttaacgtttacggttacgttaaaccccttaattttaaacgttaaccgtaacgttaaaacgtaaaagtacgttaacggtcccgttaccgtcccggccccgttacgttaccggttacgggttccggggaccgggaacgggttaaaccgaggggttacggaaacgttaacgtaaaacccgg

SEQ ID NO: 342788 - DNA, 535 bp, Homo sapiens
  misc_feature: GZ8MTXP01BQQST.11.70.G04.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctggtggganacagagtcaccatcacgttggccgggngagtcgagggcagttggactaattattagccttggtatcagcagagaccgaagggaaaccctcctaacctctagtacttctttcgctcgcactccactctcgactaagtcgacgggtccctaatctcgattcgaggtgactaggtgatcgtaggacagtacttcactctcacactcacgcacgtccctagcgtactagaatgtgtacacttaacttataacgtagtaacaaagaatacgcgcttcgcccgtcttcgttcggttcggaacgggacggaacgagggtgaacgtaacgttaacgaaacgg

SEQ ID NO: 342789 - DNA, 492 bp, Homo sapiens
  misc_feature: GZ8MTXP01BFMQ0.11.70.G04.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggngagtcaggcatggcaatattagctggtatcagcagagaccagggaaaccctcctaacctcctgactctttgctgcatccactctcgcaatcacggggtcccaatctcgtatcagtggcagtgatctgggacagattcactctcaccatcagcagctggcagcctgaagtntgtnactaacttnttaactntaaaanaaataanacgcgcgtccgccgttcgttcgttcggtcggacggaacggacggaggaggtaacgaacgtaacg

SEQ ID NO: 342790 - DNA, 580 bp, Homo sapiens
  misc_feature: GZ8MTXP01CO62W.11.70.G04.1.454.CMB.2.raw
  modified_base (202)..(202): a, c, t, g, unknown or other
  misc_feature (202)..(202): n is a, c, g, or t
  modified_base (441)..(441): a, c, t, g, unknown or other
  misc_feature (441)..(441): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatccctccctgtctgcatctggtggganacagatcacatcacttgccgggcgagtcgagggcagttggctaatattagcttggtatcagcagacgaccgaacggaaccctcctaacctctgattctttgctgcactccactctcgacaagtcgacggggtcccaattcctcgtattcgagtgggcgacgtggacgtcgtagggtactagtactttcactacttaccacctactctacgcgacgcctcgggctacgtcctaggaagtntcgttacgtactaactttattaacgtagtaaactaaaagtaacgttacgtccgccgtaccggccccgttccgttcgttacgggtttaacgggaccggggtaacgggacggtaggggttacggaacgttaacgtaaaccg

SEQ ID NO: 342791 - DNA, 675 bp, Homo sapiens
  misc_feature: GZ8MTXP01BVLFE.11.70.G04.1.454.CMB.2.raw
  modified_base (205)..(205): a, c, t, g, unknown or other
  misc_feature (205)..(205): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatccctccctgtctgcatcgtggtggganacagagtccaccatcacgttggccgggcgagtcgagggctagttggactaattatttagccttaggtatcagacaagacgaacccgaacgggtaaaccctcctaaccctctagtacttctttagctgctactccactctacgacaagtccggtacgggtccctaattccttcgtacttcgaggtcgggctagggttacgtacttcgtagggtaactagttactttaccacttaccttaccaactctacaacgccaacgtccccgtagggaccgtacggtacccgttaaggtaaagttcgttcggtttactaaccctttaaagtttactttaacgtaaacgttaaacgaaaaagtacgttaccggccgttaccgtcccggtccccgttacgtttccggttacggggtttcccggggaacggggtaacggggtaaccggtaaggggttacggtaaacgaacgttaaaaccgg

SEQ ID NO: 342792 - DNA, 536 bp, Homo sapiens
  misc_feature: GZ8MTXP01ENZ4Z.11.70.G04.1.454.CMB.2.raw
  modified_base (200)..(200): a, c, t, g, unknown or other
  misc_feature (200)..(200): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggcgaagtcgagggcagttggactaatattagcctggtatcagcagagaccagggaaaccctccgtaacctctgatctttgctgcactccactctcgactatcgacgggtcccaactctcgatcgagtggcgagtgatcgtgggacagtattcactctcacatcancacgctggacngacctagaatgtgttagactaactttatacctagtaacaaaagtaattacgaccggttctaccgtccccgcgttcgttacgggtttccgggacgggaacgggaaccgaagggttacggaacgttaacgtaaaccgg

SEQ ID NO: 342793 - DNA, 646 bp, Homo sapiens
  misc_feature: GZ8MTXP01BE3L3.11.70.G04.1.454.CMB.2.raw
  modified_base (201)..(201): a, c, t, g, unknown or other
  misc_feature (201)..(201): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctggtggganacagagtcaccatcacgttggccgggcgagtcgagggcattggactaatatttagcctggtatcagcaagagaaccgacgggaaaccctcctaaacctcctgtaacttcgtttagctgcactcccactcgtacgactaaagtccggacggggtccccaaagttcctcgtacttcgaggtcggtacaggtgactcgtaggggactagtcttacctactcctacaacatacaggaccacgccctcgggacacggtccctaggaaagttcgttacgtttacgtaaaccttaaactttaacttaaaccgttacggttaaaacaaaaaaggtaacgttaacgcccgttacgtcccggtacccccgttacgttcccggttaggggtttcccgggacgggggaaccggggaaccgtaaaggggttacgggaaacgttaacgtaaaacccggg

SEQ ID NO: 342794 - DNA, 578 bp, Homo sapiens
  misc_feature: GZ8MTXP01EHIQY.11.70.G04.1.454.CMB.2.raw
  modified_base (200)..(200): a, c, t, g, unknown or other
  misc_feature (200)..(200): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatccctccctgtctgcatctgtggganacagatcacatcacttggccgggcagtcgagggcagttggctaatattagcctggtatcagcagagaaccagggaaacctcctaaacctctagattctttgctgctactcactctcgcaagtcgacggggtcccaagttctcgtattccgaagtgggactaaggtggtacgttcgtaggggtactaggtactttcacttctacaccatcacgacacgtcctggcaggtcctaggaatagtcgttagacttaacttattactacgtaacgaaaagtacgttaaaggcgttccgtaccggccccgttcgttcggttacggtttccggggacgggtaacggggaacccgtaaggggttggaaacgttaacgtaaaacccgg

SEQ ID NO: 342795 - DNA, 741 bp, Homo sapiens
  misc_feature: GZ8MTXP01C2OY6.11.70.G04.1.454.CMB.2.raw
  modified_base (233)..(233): a, c, t, g, unknown or other
  misc_feature (233)..(233): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatctggtgggagacagacgtacaccatcacgttcggccgggngacgtcgagggcaagttggactaattattacgtctggtatcgagcagaacgaaccgaacgggaaccctacctaccctactgtatctttgctgctactccactctcgccaaacgtccgaacggggtccctaaactcgttcccgtaagttcgaacgggttgggccgtagggttagggacgttacgttacggggtaacctaaggttacttttacctaaccgttcccttaacctacctaacgttaccaaacgtccgaaccgtcccgtacggggtaccgaccggggtaacctttaccgggaaacgttaaagttcggtttacgttaaacctttaaacctttaaacgtttaaccgtaaagggtttaaaccaaaaaacgtaagttaacggtacccgttccgttaccggtaccccgttacccggtttacggttaaccggggtttccgggggtaaccggggaaacgggggtaacccgtaaacggggggttaggttaacgggaacgttaaaacccgggg

SEQ ID NO: 342796 - DNA, 692 bp, Homo sapiens
  misc_feature: GZ8MTXP01BCF9U.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttcgacccagtctccatccctccctgtctgcatcgtgtggganacagatcaccatcagttggccgggnagtcgagggctagttggactaattatttagcctggtaatcgagcagacgaccgaaggaaaccctcctaacctctagacttctttgctgacactccgactctacgactaaagtccgtaacggggtcccaaattccgtccgtaatttccgaagggttcggacctacggggttagtaaacgttcggtacggggtaacctaagggtacttttaccgaaccttccttaacccgaacctaacgttaccaaacggtccctaaacggccccttacgggacccgtacggtaccccgttaagggaaacttagttaccggtttacgtaaacctttaaacgttttaaacgttaaccttaaagggtaaacctaaaaaagggtacttaaacgcgttaccgtaccgtccccgttacgttcgttacgggttcgggacgggtaacgggaccggtaagggttacggaagttaacgtaaaaccgg

SEQ ID NO: 342797 - DNA, 453 bp, Homo sapiens
  misc_feature: GZ8MTXP01BG34C.11.70.G04.1.454.CMB.2.raw
  modified_base (289)..(289): a, c, t, g, unknown or other
  misc_feature (289)..(289): n is a, c, g, or t
  modified_base (445)..(453): a, c, t, g, unknown or other
  misc_feature (445)..(453): n is a, c, g, or t
tcagcgagagataccacgaccggtgctcgatttagtgtagtgtgaagggaaagggattggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtattgttaggacctccactacggtatggacgtctggggccaagggaccacggtcaccgtcncctcagcctccaccaaggcccatcggtcttccccctggccacccctcctaccaagacgcacctcgtgggggcacgagccggccccctggggctgcctggtacaacggtctacttccgtatctctcgctgacgcgggctggcgaaggcgacgatagnnnnnnnnn

SEQ ID NO: 342798 - DNA, 461 bp, Homo sapiens
  misc_feature: GZ8MTXP01EY9G0.11.70.G04.1.454.CMB.2.raw
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
  modified_base (452)..(461): a, c, t, g, unknown or other
  misc_feature (452)..(461): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctgggggccaagggaccacggtcaccgtcncctcacgcctccaccaaagggccccatccggtccttcccccctggccacccctcctccaagacgccacctcgtggggggccacgagccggccccccngggctgccctggtcaaggctacttccgtatctctcgctgagcgggctggcaaggcgacatagnnnnnnnnnn

SEQ ID NO: 342799 - DNA, 666 bp, Homo sapiens
  misc_feature: GZ8MTXP01EHWOF.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcgagtcgaggcatggcaatattagcctggtatcagcagagaccaacgggaacctcctaacctcctagactctttgctgcactccactctcgctaaatcgacggggtcccaaagttcctcgtacttacgagttggactagggtcggtaacgtccgttaggggaaccaggttaactttcctaaccttacctacctaccccttaaacgtaccacgaccgtacgtccgtacggtaccgtacggtaccgtaacgtaaacgttaacgttacgttacgttaaaccttaaacgtttaacgttaaccgttaacgtaaacgtaaaacgtaaacgttaacgtaccgttacccgtacccgtaccccgttacccgttaccgttaccgggttaaccggggtaccggggtaacgggtaacgggtaacgggttaacgggtaacggttaaacgtaaaccg

SEQ ID NO: 342800 - DNA, 450 bp, Homo sapiens
  misc_feature: GZ8MTXP01AFKBP.11.70.G04.1.454.CMB.2.raw
  modified_base (443)..(450): a, c, t, g, unknown or other
  misc_feature (443)..(450): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttaggacctccactacggtatggacgtctggggccaagggaccacggtcaccgtctctcagcctccaccaaggcccatcggtccttccccctggccacccctcctccagacgcacctcgtgggggcacgacgccggcccccgtgggctgcccgtggacaagggcctacttccgtatctctcgctgagcgggctggcgaaggcgcatagnnnnnnnn

SEQ ID NO: 342801 - DNA, 733 bp, Homo sapiens
  misc_feature: GZ8MTXP01A9IAQ.11.70.G04.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatccctccctgtctgcatcgtggtggganacagagtcacatcacgtcggccgggngagtcgagggtctagtggactaattgttagccttggtatcgagacagaacgaaccgacggtaaacccctcctaacctctagtattctttgctgacctactccacgtctcgactaaacgtccggtacgggtcccctaaagttccgtcgtattacccggaggttcgggacgtaagggtcgggtacttaccgggtagggtaactaaaggttctttacccacttacctacctaacctactcgaaacgtccgaacggtccctagggaacccgtaaggtaccccgttaaaggtaaacgttagttaccgggtttaaccgtaaaccgtttaaaacgttaacgtttaaacttaaccggttaaaagtaaaaaaagttaacggttaaccggtacccgttacccgtttcccgggaacccccgtttcgttaacccgggttacgggttaacccggggaacgggttaacgggaacccgggttaagggaacgggtaaaccgttaacgttaaaaacccggg

SEQ ID NO: 342802 - DNA, 488 bp, Homo sapiens
  misc_feature: GZ8MTXP01AKDI4.11.70.G04.1.454.CMB.2.raw
  modified_base (291)..(291): a, c, t, g, unknown or other
  misc_feature (291)..(291): n is a, c, g, or t
  modified_base (482)..(488): a, c, t, g, unknown or other
  misc_feature (482)..(488): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtcncctcacgcctccaccaacgggccccatccggtccttcccccctcggccacccctccctcccaacgaggccacccgtcgtcggggggccaccgacggccggcccccccgtgggggctcggccctggggtaccaaacgggtcctaccttcccggtattcctctcgctcgagcgggctgggcaaggcgcatagnnnnnnn

SEQ ID NO: 342803 - DNA, 452 bp, Homo sapiens
  misc_feature: GZ8MTXP01C9L8M.11.70.G04.1.454.CMB.2.raw
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (443)..(452): a, c, t, g, unknown or other
  misc_feature (443)..(452): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtattgttagggacctcactacggtatggacgtcgtggggccaagggaccacggtcaccgtcncctcagcctccaccacggcccatcggtcctcccctggcncccctcctccaagcgccaccgtcgtgggggccacgaggccggcccccgtgggctgccgtggtacaaggctacttccgtatctctcgctggagcgggctgggcaaggcgcatagnnnnnnnnnn

SEQ ID NO: 342804 - DNA, 648 bp, Homo sapiens
  misc_feature: GZ8MTXP01CCBK3.11.70.G04.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcagtcagggcatggactaatattagctggtatcagcanagaccaagggaaacctcctaacctcctagatctttgctgcactccactctacacaactcgacggtcctaatctcgtattacgaggtggacgtaggtaggtactcgtaggtactagtactttacctacttacctacaacctacacgacgactacgtaccgtacggacgtacgtaccgtaacgtaaagtaagttacgttacgttaacttaaactttaaactttaaacgttaaacgtaaaacgtaaaaaacgtaaaacgttaacgtaccgttacccgtacccgtaccccggttacccgttaccggttaccgggtttaaccggggtaaccgggggtaaccggggtaaaccgggtaaacggggttaacgggtaaacggttaaacgtaaaccg

SEQ ID NO: 342805 - DNA, 771 bp, Homo sapiens
  misc_feature: GZ8MTXP01AR4ZN.11.70.G04.1.454.CMB.2.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatccctccctgtctgcatctggtggganacagagtccaccatcacgttcggccgggngagtcgagggctagttggactaaattatttagccttggtatcgagcaaggacgaaccgaacggggtaaacccctcctaacccttcctagtactttccgtttgctcgcactccactctacgcatcgaacgggtccctaagtcctcgtacttcgaggtcgcgaggtggtacgttcgtagggtaactaggttactttacctaccttaccctacctaaccctacttaccgaacgcccgtaaccgtccccgtacggggtacccgtaaccggttaccccgtaaaggtaaaccgttaagtttacgggtttacggtaaaccctttaaacggtttttaaaccttttaaaccgttaacggttaaaacccgtaaaaaaggttaacgttacccggggtaacccgttcccggttaaccccggtccccccggttacgtttaccccgggttaacgggggttttaaccccggggggaacccgggggttaaccgggggaaaccccgggtaaagggggttaccggggtaacggttaaaaccggttaaaaaccccgggg

SEQ ID NO: 342806 - DNA, 575 bp, Homo sapiens
  misc_feature: GZ8MTXP01CB3M3.11.70.G04.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (458)..(458): a, c, t, g, unknown or other
  misc_feature (458)..(458): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctcctgtctgcatcgtggtgganacagacgtcaccatcacgttggccgggngagtcgagggcagttggactaagttattacgcttaggtatcgagcagagaccgacggaaacctcctaacctcctatacttcgttacgactcgacactccactcgtcactaagtccgacggggtccctaagtccttcgtacttcgagggtcgacgtaggtggctacgtcgggaactagtactttccaacttacctcaacctatacacgcacgacctacgacgtacgtanaagtactgtacacttaattatactataacaaaggtaactaggctccgcgtcccgtgttacgttggttccgggaacggtacggaaccgtaggtacggactaacgttaacgtaaaccgg

SEQ ID NO: 342807 - DNA, 595 bp, Homo sapiens
  misc_feature: GZ8MTXP01BQ1AU.11.70.G04.1.454.CMB.2.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtcctccatcctccctgtcngcatctgtggganacagngtcacatcacttgccgggnagtcgagggcattggactaattattagcctggtactcgagcagacgaccgaaggggtaaacccctcctaaacctcctagtactttcgtttcgcttgacctactcccacttcctgacctaaagtcgaacggggtcccaaagttcctcggattcgacggtgcagggtcgatcgtagggactaggtactttcacttcctactacctactcgacgcacgtccctagacgccgtagacgtatagtcgacttaaacttacttacgtacgttaaacgaaaggaacttaacgccgtacttcccggcccgtacgttccgttcgggtttaccggcgggtaagggaaccgtagggacggttagtaaccgttaagaaaccgg

SEQ ID NO: 342808 - DNA, 614 bp, Homo sapiens
  misc_feature: GZ8MTXP01D2G1L.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccattctccatccctccctgtctgcatctgtgganacagagtcacatcacttggccgggngagtcgagggcagttggactaattattagccttggtatcagcagagaaccgaacgggaaacccctcgtaaacctcctagtacttctttgctncactccactctcgactaagtcgacgggtcccaacttctcgatttcgaggttgacgtaggtaggactcgtagggtactagtatttcactctacactagtcacgctaacgcctggggactacggtacctagggaaataagttcgttaacgtaacccttaaagtttaacgttaacttaacggttaaacaaaaaacgtaaagttacggtaccgttccgtaacccggtccccgttacgttcgttacggtttccggggacgggaacggtacccgaagggttagaacgttaacgtaaaaccgg

SEQ ID NO: 342809 - DNA, 628 bp, Homo sapiens
  misc_feature: GZ8MTXP01B3RDZ.11.70.G04.1.454.CMB.2.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (529)..(529): a, c, t, g, unknown or other
  misc_feature (529)..(529): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatctggtggganacagagtcaccatcacgtggccgggngagtcgagggcagttggactaattattagcctggtatcagcagacgaaccgacggaaaccctccgtaaacctcctgtacttctttgctcgctactccactctacgacctaagtccgtacgggtccctaacttctcgtactttcgacggttcggacgtagggttacggacttacggtacgggaactacgttactttacctacctaccttaccacctacgtacacgactacgcctacggcgtacgtccgtaggtaacgtagttcgttacgtaactttaactttaacgttactaacgttaaanaaaacggtattacgccgttccgtacccgtcccgttcgttcgttacgggttcgggacgggtaacgggtaccgagggttaggtaacgttaacgtaaaccgg

SEQ ID NO: 342810 - DNA, 682 bp, Homo sapiens
  misc_feature: GZ8MTXP01A59YD.11.70.G04.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
tcagcgagagataccacgaccggtgctcgatttagtgtagtgtgaagggaaagggggcagaagtctctctcagtcaggacacagcatggacatgagggtccctgctcagctcctgggacctcctgctgctctggctcccagatgccagatgtgacatccagttcgacccagtcctccatccctccctgtcngcatctggtggganacagagtccacatcacgttcggccgggcgagtcgagggcagttggactaatattacgccttggtatcagcagacgaaccgacggaaacctcctaacctctgtattcgtttgctgctactccgactctacgactactccggacgggtacccctaagttccgttcggtacttacggacggttcgggacgtaggggtaggtaacttcgggttacgggaaccttaaggttacctttacaccttcctacccttacgacttaccgacggtaccacgttccccggacggaacgacggtaccgtagtaacgttacgtttacgttaacgttaacttaaactttaacgttaacgtaaacgtaaacgtaaaacgtacgttaccggtacccgttccgtacccggtacccgttacgttccgggttaccggggttaaccggggaccgggtaacgggtacggtaagggttaccggtaacgttaacggtaacg

SEQ ID NO: 342811 - DNA, 682 bp, Homo sapiens
  misc_feature: GZ8MTXP01BRNJI.11.70.G04.1.454.CMB.2.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccactccctccctgtctgcatctggtggganacagcgtccaccntcacgttcggccggcagtcgagggctagttggactaattattacgccttggtatcgagcaaggacgaaccgaacggtaaaccctccgtaacctcctagtacttcgtttacgcttcgactaccttccaacgtcctaccgactaaacgttccgggtaacgggtccccaaagttcctcgtacgtttccgaggttcgggactagggtgtactcggtaggactagtactttacacttactacctaactctcaacgcctaacgcccgttaggacctacggtacctaggaaacgtacgtttcgttaacgtaaccctttaaacgttaactttaacgtaacggttaaaacgaaaacgttaaccgttaacggcccgttccgtacccgtaaccccgttcgtttaccgggttacgggtttaaccggggacgggtaacgggtaacccgtagggacccggtaagttaacgtaaaccgg

SEQ ID NO: 342812 - DNA, 739 bp, Homo sapiens
  misc_feature: GZ8MTXP01CXUTZ.11.70.G04.1.454.CMB.2.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
tcagcgagagataccacgaccggtgctcgatttagtgtagtgtgaagggaaaggggcagaagtctctctcagtcaggacacagcatggacatgagggtccctgctcagctcctgggctcctgctgctctggctccagatgccagatgtgacatccagttcgaccagtctccatccctcctgtctgctatcnggtggganacagctccaacntcgacgtcggaccgggtcagtcgagggtctagttggactaattacgttagccgttaggtattacgacgtacgaagacgaaacccgtacggggaaaaccccttccctaaaccccttcgttacgtaactttccgttttagcttacggtcctacttaccgactttcgtaccggactaaacgttcccgacggggtacccaaggttccctaaggtaaactttccgaaggttcggggaactgggttacggatcgttagggacctagtctttaccaacgttccactaacctactacacgacacgtcccgttaggacccgtacggtaacccttaggaaacgttagttcggttacccgttaagttaaaccctttagtttaaacgtaaaccggtaaactaaaaaagggtaccttacgggaccggttccgttaaaccccgggtcccgttaaccggttcggtttaacccgggggttaacgggcccggggtaagggttaccccgaaaggggttcgggaaaagttaacgggtttaaaaaccg

SEQ ID NO: 342813 - DNA, 470 bp, Homo sapiens
  misc_feature: GZ8MTXP02GJU03.11.70.G04.1.454.CMB.2.raw
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccggcgagtcagggcattggcaattattagcctggtatcagcagagaccagggaaacctcctaacctcctgatctttgctgcatccactctgcaatcaggggtcccatctcgattcagtgcagtgatctgggacagatttcactctcacatcagcagcctgcagcctgaagatgttgcaaacttattactagttacaaaagaatagacgctacgccccgctcagtttcgcggaggaccaggtggagataacg

SEQ ID NO: 342814 - DNA, 471 bp, Homo sapiens
  misc_feature: GZ8MTXP02JVKPH.11.70.G04.1.454.CMB.2.raw
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccggcgagtcagggcattggcaattattagcctggtatcagcagagaccagggaaacctcctaacctcctgatctttgctgcatccactctgcaatcaggggtcccatctcgattcagtgcagtggatctgggacagatttcactctcaccatcagcagcctgcagcctgaagatgttgcaacttattactgtacaaaagaatagcgactgccccgctcagtttcggcggtagggaccaggtcggagataacg

SEQ ID NO: 342815 - DNA, 485 bp, Homo sapiens
  misc_feature: GZ8MTXP02IMIIO.11.70.G04.1.454.CMB.2.raw
  modified_base (431)..(431): a, c, t, g, unknown or other
  misc_feature (431)..(431): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccggcgagtcagggcattggcaattattagcctggtatcagcagagaccagggaaacctctaaacctcctgatctttgctgcatccatctgcaatcagggtccatctcgattcagttgcagtgatcgtgggacagatttcactctcaccatcagcagctcgcacgcctgaagaagtgttagtactaacttattactagtactaaaagaaatanacgctacgccgcctctacgttcggcggacggaccgaggtacggacgagtaaacg

SEQ ID NO: 342816 - DNA, 487 bp, Homo sapiens
  misc_feature: GZ8MTXP02JKQVZ.11.70.G04.1.454.CMB.2.raw
  modified_base (392)..(392): a, c, t, g, unknown or other
  misc_feature (392)..(392): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccggcagtcagggcattggcaattattagctggtatcagcagagaccagggaaacctcctaacctcctgatctttgctgcatccactctgcatcagggtccatctcgattcagtgcagtgatctgggacagattcactctcaccatcagcagcctgcagcctagaagatgttanactaacttatactagtaacaaaagtatagacgtctcgtcctcgtctacgtaacggttacgggacgggacggacgtaacgggtacggaacgtaacg

SEQ ID NO: 342817 - DNA, 432 bp, Homo sapiens
  misc_feature: GZ8MTXP02INOBL.11.70.G04.1.454.CMB.2.raw
  modified_base (430)..(432): a, c, t, g, unknown or other
  misc_feature (430)..(432): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaaggccatcggtcttccccctggccaccctcctccaagagcacctctggggcacagcggccccctgggctgcctggtcaaggctacttcgtatctctcgctgagcgggctggcaaggcgcatagnnn

SEQ ID NO: 342818 - DNA, 485 bp, Homo sapiens
  misc_feature: GZ8MTXP02JM3KC.11.70.G04.1.454.CMB.2.raw
  modified_base (199)..(199): a, c, t, g, unknown or other
  misc_feature (199)..(199): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcagtcagggcattggcaattatttagcctggtatcagcagagaccagggaaacctccgtaacctcctgatctttgctgcatccactctgcatcacggggtccagtctcgattcagtgcagtgatcnggacagattcactctcacatcagcagctgcngcctgaagatgtgactaacttattactgtactaaaataatacgtcgacgtcgccccgctcgtacggtttcggcggaacgggaccgaaggtggacgacgtaaaccgg

SEQ ID NO: 342819 - DNA, 521 bp, Homo sapiens
  misc_feature: GZ8MTXP02IOF1J.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggnagtcagggcattggctaattattagcctggtatcagcagagaccagggaaacctcctaacctcctgatctttgctgcatccactctgcatcgacgggtcccatctcgtattcgagtgcgtagtggatcgtggacagtattcactctcacatcagcacgcctacacgcctgaagtactgttagactaacttattacttagtaacaaaagaatacgacgtctaccgcccgtctaccgtaggtttccgggaacgggtacgggaaccgtaacgggtaggaacgtaacgtaacgtaaaacgg

SEQ ID NO: 342820 - DNA, 442 bp, Homo sapiens
  misc_feature: GZ8MTXP02J1R6W.11.70.G04.1.454.CMB.2.raw
  modified_base (438)..(442): a, c, t, g, unknown or other
  misc_feature (438)..(442): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggccccatcggtcttccccctggcacccctcctccaagacgcacctctggggcacagcggccccctgggctgcctggtccaaggcctacttcccgtatctctcgctgagcgggctggcaaggcgcatagnnnnn

SEQ ID NO: 342821 - DNA, 478 bp, Homo sapiens
  misc_feature: GZ8MTXP02G3BEX.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaacatcacttgccgggcgagtcaggcattggcattattagcctggtatcagcagagacagggaaacctcctaacctcctgatctttgctgcatccactctgcaatcaggggtccatctcgattcagtgcagtgatctggacagattcactctcaccatcagcagcctgcagcctgaagatgtgacaacttatactgtacaaaagatagacgctacgccccgtactcaggtttcggcggaacgggaccgaagggtacggaagactaaaccgg

SEQ ID NO: 342822 - DNA, 485 bp, Homo sapiens
  misc_feature: GZ8MTXP02IZV6V.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggnagtcgagggcattggcaattattagcctggtatcagcagagaccagggaaacctcctaacctcctgatctttgctgcatccactctgcatcaggggtccatctcgattcagtgcagtgatctgggacagatttcactctcacntcagcagcctgctagcctgaantgtnctaacttatactagtacaaaagataagcgacttcgccccgtctcgtacgtttccggacggacgggacccgaaggtacggaagtactaaaccgg

SEQ ID NO: 342823 - DNA, 469 bp, Homo sapiens
  misc_feature: GZ8MTXP02JIQTE.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccattctccatcctccctgtctgcatctgtggganacagagtcaccatcacttgccggcgagtcaggcattggcatattagcctggtatcagcagagaccagggaaacctctaacctcctgatctttgctgcatccactctcgcaatcaggggtcccatctcgattcagtgcagtggatctgggacagatttcactctcaccatcagcagcctgcagcctgaagatgttgcaacttattactgtactaaaagatagcgctcgaccccgctcaggtttcggcggaggaccaaggtcgaggataacg

SEQ ID NO: 342824 - DNA, 475 bp, Homo sapiens
  misc_feature: GZ8MTXP02G30Q5.11.70.G04.1.454.CMB.2.raw
  modified_base (199)..(199): a, c, t, g, unknown or other
  misc_feature (199)..(199): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcaattattagcctggtatcagcagagaccagggaacctcctaactcctgatctttgctgcatccactctcgcaatcgagggtccagtctcgattcagtgcagtgatctggacagatttcactctcaccatcagcagcctgcagctagagatggttnactaacttntactgactaaaagatagcactcgccccgntacgtagttcggcggaacggaccgaaggtcggaagagtaaacg

SEQ ID NO: 342825 - DNA, 506 bp, Homo sapiens
  misc_feature: GZ8MTXP02G2WBF.11.70.G04.1.454.CMB.2.raw
  modified_base (198)..(198): a, c, t, g, unknown or other
  misc_feature (198)..(198): n is a, c, g, or t
  modified_base (394)..(394): a, c, t, g, unknown or other
  misc_feature (394)..(394): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacttgccggcgagtcagggcattggcaattattagctggtatcagcagagaccaggaacctcctaacctctgatcttgctgcatccactctgcaatcgacggggtccatctcgattcagtgcagtggatcgtagggactagattcactctcaccatcacgcaacgcctgcagccctagaagntagttgactaacttattacgtagtaacgtaaaagtaatagaccgtctacgaccccgtctaccgtacggttcggacggacgggtaaccgaagggtaggacgtaactaaaccgg

SEQ ID NO: 342826 - DNA, 435 bp, Homo sapiens
  misc_feature: GZ8MTXP02GI3W3.11.70.G04.1.454.CMB.2.raw
  modified_base (432)..(435): a, c, t, g, unknown or other
  misc_feature (432)..(435): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgttgtcccttgaaagtaattgttagggacctcactacggtatggacgtctggggccaagggaccacggtcaccgtctcctcagcctccaccaagggcccatcggtcttccccctggcaccctcctccaagagcacctctgggggcacagcggcccctgggctgcctggtcaagggctacttccgtatctctcgctgagcgggctggcaaggcgcatagnnnn

SEQ ID NO: 342827 - DNA, 498 bp, Homo sapiens
  misc_feature: GZ8MTXP02GD1F6.11.70.G04.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggnagtcagggcattggcaattattagcctggtatcagcagagaccagggaaacctcctaacctcctgattctttgctgcatccactctcgcaatcacggggtcccatctcgatcagtgcagtgatcgngggacagtattcactcncacatcagcagcctgcagcctagaagatgtgactaacttatactagtaacaaaagtatagacgactccgacccgtctacgtacggtttccggacggtaacgggaaccgaagggtacggaagacgtaaaccg

SEQ ID NO: 342828 - DNA, 471 bp, Homo sapiens
  misc_feature: GZ8MTXP02GKDHJ.11.70.G04.1.454.CMB.2.raw
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtgggagacagagtcaccatcacttgccggcagtcagggcattggcaattattagcctggtatcagcagagaccagggaaacctctaacctcctgatctttgctgcatccactctgcaatcagggtcccatctcgattcagtgcagtgatctggacagatttcactctcacatcagcagcctgcagcctagacgatgttgctaacttatactagtacaaaagataagcgactcgcccgctctagttcggacggaggaccgaaggtcggaagacgtaaacg

SEQ ID NO: 342829 - DNA, 491 bp, Homo sapiens
  misc_feature: GZ8MTXP02JWH2D.11.70.G04.1.454.CMB.2.raw
  modified_base (199)..(199): a, c, t, g, unknown or other
  misc_feature (199)..(199): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcgagtcagggcattggcaattatttagcctggtatcagcagagacagggaaacctcctaacctcctgattctttgctgcatccactctcgcaatcacgggtcccatctcgattcagtgcagtgatctgggacagtatttcactctacaccatcagccagcctcgcagcctagaagaatggttntactacttattactagtataaaanaagtagacgcgcgcccgctcgtcgttcggtcggacgggaccgaaggacggacgataaaccg

SEQ ID NO: 342830 - DNA, 498 bp, Homo sapiens
  misc_feature: GZ8MTXP02J2M34.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (391)..(391): a, c, t, g, unknown or other
  misc_feature (391)..(391): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctggtggganacagagtcaccatcacttgccgggngagtcagggcattggcaattattagcctggtatcagcagagaccagggaaacctcctaacctctgattctttgctgcactccactctcgacaagtcgacggggtcccatctcgattcagtgcagtgatcgtggacagtattcactctcacatcagcagcctagcngcctgaagatggttacactacttattactagaactaaaacggataggctactcgccccgctacgtacggttcggacgggacggaccgaagggtcgaacgtacaaccg

SEQ ID NO: 342831 - DNA, 485 bp, Homo sapiens
  misc_feature: GZ8MTXP02J0E3T.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcgagtcagggcattggcaattatttagcctggtatcagcagagaccagggaaacctcctaacctcctgatctttgctgcatccactctgcatcaggggtccatctcgattcagtgcagtgatcgtggacagattcactctcaccatcagcagcctgcagccctagaagtatgttgctaactttattactgttaacaaaagaatagcgactcgcccgactcgacgtttcggacgggacggaccgaggtcggagacgtaaaccgg

SEQ ID NO: 342832 - DNA, 482 bp, Homo sapiens
  misc_feature: GZ8MTXP02JW2KU.11.70.G04.1.454.CMB.2.raw
  modified_base (377)..(377): a, c, t, g, unknown or other
  misc_feature (377)..(377): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattattagcctggtatcagcagagaccagggaaacctcctaacctcctgatctttgctgcatccactctgcaatcacggggtccatctcgattcagtgcagtggatctgggacagatttcactctcacatcagcancctgcagcctgaagactgttgactaacttattactagtacaaaagatagcgactcgccccgctctacggtttcggcggacgggacgaacggtggaacgataaccg

SEQ ID NO: 342833 - DNA, 431 bp, Homo sapiens
  misc_feature: GZ8MTXP02H4LQ5.11.70.G04.1.454.CMB.2.raw
  modified_base (343)..(343): a, c, t, g, unknown or other
  misc_feature (343)..(343): n is a, c, g, or t
  modified_base (427)..(431): a, c, t, g, unknown or other
  misc_feature (427)..(431): n is a, c, g, or t
tcagcgagagataccacgaccggtgctcgatttagtgtagtgtgaagggaaagggactggagtggattggtcatatcgataccactggaacaccaattacaacccctccctcaagagtcgagtcaccatatccctgacgtccaagagtcagctctccctggagctgacttctgtgaccgccgcagacacggccgtgtattactgtgcgcgacgtcgtccttgaaagtaattgttagggacctccactacggtatggacgtctggggccaagggaccacggtcaccgtctcctcagcctccaccaagggcccatcggtcttccccctggcacccctctccaagngcactctggggcacagcgcccctggctgcctggtcaaggctacttcgatctctcgctgacgtcgggctggcaagggcgcatagnnnnn

SEQ ID NO: 342834 - DNA, 560 bp, Homo sapiens
  misc_feature: GZ8MTXP02F0VO7.11.70.G04.1.454.CMB.2.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcgagtcaggcattggcaattattagcctggtatcagcagagaccagggaaacctcctaactcctgatctttgctgcatccactctgacagtcgacgggtcccatctcgatcagtgcagtgatcgtggacagtattcnctcncacatcancacgcctagcagcctagaagtacgttgttacgtactaaactttaattaaccgtagttaaaacgaaaaacgttaacgtaacggccgtaccgttacccggtacccccgtacgtaccgttaacgggtttcccggggacgggaacggggttaaacccggaagggtacgggtaaacggaacgttaaaacccgg

SEQ ID NO: 342835 - DNA, 496 bp, Homo sapiens
  misc_feature: GZ8MTXP02IJ6T9.11.70.G04.1.454.CMB.2.raw
  modified_base (395)..(395): a, c, t, g, unknown or other
  misc_feature (395)..(395): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcgaggcattggcaattattagcctggtatcagcagagaccagggaaacctcctaacctctgtatctttgctgcatccactctcgcaatcgacggggtccagtctcgtattcagtgcagtgatcgtgggacagtattcactctcacatcagcagcctgcagctagaantgtagactaacttatactagtaacaaaagatagacacgtacgcccgtctacgacggtttaacggcgggaacggtaccgaaggtacggaacgacgtaaaacg

SEQ ID NO: 342836 - DNA, 486 bp, Homo sapiens
  misc_feature: GZ8MTXP02IBTNF.11.70.G04.1.454.CMB.2.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
  modified_base (435)..(435): a, c, t, g, unknown or other
  misc_feature (435)..(435): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggcgagtcagggcattggcaattattagcctggtatcagcagagaccagggaaacctcctaaccncctgatctttgctgcatccactctgcaatcacggggtccatctcgattcagtgcagtgatcgtggacagatttcactctcacatcagcagctgcagcctagagatgtgactaacttattactatacaaaagataagcgtctacgcccncgtcacggtttccggacggaacggggaccaagggtcggaagacgtaaaccg

SEQ ID NO: 342837 - DNA, 497 bp, Homo sapiens
  misc_feature: GZ8MTXP02FYKXG.11.70.G04.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (353)..(353): a, c, t, g, unknown or other
  misc_feature (353)..(353): n is a, c, g, or t
  modified_base (401)..(401): a, c, t, g, unknown or other
  misc_feature (401)..(401): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggngagtcagggcattggcaattattagcctggtatcagcagagaccagggaaacctcctaactcctgatctttgctgcatccaactctcgacatcgacggggtcccatctcgatcagtgcagtgatcgngggacagtattcactctcacatcagcagcctgcagcctagaagatgtnactaacttatactagttaacaaaagtataagcgactcgccccgactctacggtttcggacggaacgggaaccgaaggtaggaacgacgtaaaaccg

SEQ ID NO: 342838 - DNA, 476 bp, Homo sapiens
  misc_feature: GZ8MTXP02HY51P.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggngagtcagggcattggcaattattagcctggtatcagcagagacagggaaactcctaacctcctgatctttgctgcatccactctcgcaatcaggggtccatctcgattcagtgcagtgatcgtggacagtattcatctcacatcagcagcctgctagcctgagatgtncacttatactgtacaaaagatagacnctcgcccgctcgtagtttccggacggaacgggaccgaaggtacggagtaacgaaaccgg

SEQ ID NO: 342839 - DNA, 546 bp, Homo sapiens
  misc_feature: GZ8MTXP02GTLNZ.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcgagtcagggcattggctaattattagcctggtatcagcagagaccagggaaacctcctaacctcctgattctttgctgcactccactctcgactaatcgacgggtcccattctcgtattcgagtgctagtgatcgtggactgtacttcactctcacatcagcacgcctgcagcctagaacgtattgtacgactaaactttattaactagtaaacgtaaaagtacgttaacgccgtacgtaccggacccccgtcgttaccgtaacgggtttccggaacggggtaacgggtaaccgaagggttacggaacgtaacgtaaaaccgg

SEQ ID NO: 342840 - DNA, 541 bp, Homo sapiens
  misc_feature: GZ8MTXP02H5OGH.11.70.G04.1.454.CMB.2.raw
  modified_base (201)..(201): a, c, t, g, unknown or other
  misc_feature (201)..(201): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatccctccctgtctgcatctgtggganacagagtcaccatcacttggccgggcgagtcgagggcattggacaatttattagcctggtatcagcagagaccaaggaaacctcctaacctctgatctttgctgcatccactctcgacaatcgacgggtcccattctcgtattcgagtgctaggtgatcgtagggactagtactttcactctacacatcagtcacgctgcagcctagaacgtagtgttacgacttaacttattaactacgaaaaccaaaagaactacgccgtactccgccccgtacgttacgtacgggtttccggacgggaacgggaaccgtaaggggtacggaaacgaacgtaaaccgg

SEQ ID NO: 342841 - DNA, 477 bp, Homo sapiens
  misc_feature: GZ8MTXP02JZVTG.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggngagtcagggcattggcaattattagcctggtatcagcagagaccagggaaacctcctaacctcctgatctttgctgcatccactctgcatcacgggtccatctcgattcagtgcagtgatctgggacagatttcactctcaccatcagcagctgcagcctgagatgttgctaacttattactgtacaaaagtaatagcgactcgcccgctcgtacgtttcggcggacgggaccgaaggtcggacgagtaaaccg

SEQ ID NO: 342842 - DNA, 431 bp, Homo sapiens
  misc_feature: GZ8MTXP02I8AF2.11.70.G04.1.454.CMB.2.raw
  modified_base (427)..(431): a, c, t, g, unknown or other
  misc_feature (427)..(431): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaaggcccatcggtctccccctggcaccctcctccaagagcacctctggggcacagcgcccctggctgcctggtcaaggctacttccgtatctctcgctgagcgggctggcaaggcgcatagnnnnn

SEQ ID NO: 342843 - DNA, 545 bp, Homo sapiens
  misc_feature: GZ8MTXP02G4D6A.11.70.G04.1.454.CMB.2.raw
  modified_base (200)..(200): a, c, t, g, unknown or other
  misc_feature (200)..(200): n is a, c, g, or t
  modified_base (401)..(401): a, c, t, g, unknown or other
  misc_feature (401)..(401): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcagggcattggcaattattagcctggtatcagcagagaccagggaaaccctcctaacctcctgactctttagctgcactccactctcgcatcgacgggtccattctcgattcgagtggcagtgatccgtgggacagtacttcactctcacatcagcagcctgcacgctaganatgtagactaactttattacctagttaaacaaaagtaacgttagaccggtacttaccgaccccgtacgttaccgtacgggtttaaccggggacggtaaccggggtaccgaaaggggttaccggaaggtaacgttaaaacccggg

SEQ ID NO: 342844 - DNA, 430 bp, Homo sapiens
  misc_feature: GZ8MTXP02HWZP9.11.70.G04.1.454.CMB.2.raw
  modified_base (406)..(406): a, c, t, g, unknown or other
  misc_feature (406)..(406): n is a, c, g, or t
  modified_base (427)..(430): a, c, t, g, unknown or other
  misc_feature (427)..(430): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctcactacggtatggacgtctggggccaagggaccacggtcaccgtctcctcagcctcaccaaggcccatcggtcttccccctggcaccctcctccaagagcacctctggggcacagcgccccctgggctgcctggtcaaggctacttcgtatctctcgctgancgggctggcaaggcgcatagnnnn

SEQ ID NO: 342845 - DNA, 475 bp, Homo sapiens
  misc_feature: GZ8MTXP02FP36M.11.70.G04.1.454.CMB.2.raw
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcagtcagggcattggcaattattagcctggtatcagcagagaccagggaaacctcctaacctcctgatctttgctgcatccactctcgcaatcaggggtcccatctcgatcagtgcagtggatctgggacagatttcactcncaccatcagcagcctgcagcctagaagntgttgctaacttntactgtacaaaagataagcgactcgccccgactctacgttcgacggaggtaccgaggtgacgataaacg

SEQ ID NO: 342846 - DNA, 499 bp, Homo sapiens
  misc_feature: GZ8MTXP02GLX4I.11.70.G04.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggngagtcagggcattggctaattattagcctggtatcagcagagaccagggaaacctcctaacctctgatctttgctgcactccactcncgcaatcgacgggtccatctcgatcagtgcagtgatcgtgganagtattcactctcacatcagcagcctgcagccaganatgtacactaacttatactagtaataaaacgattagcgtacgtcgacccgtactcgtaacggttcgggacggaacgggaccgtaagggtacgtacgacgtaaaaccg

SEQ ID NO: 342847 - DNA, 501 bp, Homo sapiens
  misc_feature: GZ8MTXP02HWWEG.11.70.G04.1.454.CMB.2.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacttgccgggcgagtcagggcattggcaattatttagcctggtatcagcagagaccagggaaacctcctaacctcctgatctttgctgcaatccactctcgcaatcaggggtcccatctcgattcagtgcagngatcnggacagattcactctcaccatcagcagtccncncancagagagtagtagactaacttaattactagtaactaaaacgaaagtacgacgacgtaccgcccgtcctacgtacgtcggtacggaacggacggaacggacggaacgaacgtaacg

SEQ ID NO: 342848 - DNA, 602 bp, Homo sapiens
  misc_feature: GZ8MTXP02I72CO.11.70.G04.1.454.CMB.2.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcaccatcacttgccgggcagtcgagggcattggcattattagcctggtatnagcagagaccagggaacctacctaacctctgatctttagactgcatccactctcgactactcgacggggtcccacttctcgtaattcaagttcgctaagtacggacgtcgttaggacagtattactactctacacactacacgacacgcctggacctagtaccctagaagtaacgttaggttagaaccgttaaactttacgttaacccgtaagttaaaaccgtaaaagtaaacgttacgaccgtaccgtaccgtaccccgtacgttaccgtacgggtttaaccgggtaccggggtaaccggggaaccggtaaacgggttacggaaacggttacgtaaaacccgg

SEQ ID NO: 342849 - DNA, 448 bp, Homo sapiens
  misc_feature: GZ8MTXP02JK7AB.11.70.G04.1.454.CMB.2.raw
  modified_base (441)..(448): a, c, t, g, unknown or other
  misc_feature (441)..(448): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctcactacggtatggacgtctggggccaagggaccacggtcaccgtctcctcagcctccaccaagggccccatccggtcttcccccctggccacccctcctccaacgacgcacctcgtgggggcacagccggcccccgtgggctgcctggtcaaggctacttccgtatctctcgctgagcggctggcaaggcgcatagnnnnnnnn

SEQ ID NO: 342850 - DNA, 509 bp, Homo sapiens
  misc_feature: GZ8MTXP02IUEWV.11.70.G04.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (461)..(461): a, c, t, g, unknown or other
  misc_feature (461)..(461): n is a, c, g, or t
tcagcgagagataccacgaccggtgctcgatttagtgtagtgtgaagggaaagggggcagaagtctctctcagtcaggacacagcatggacatgagggtccctgctcagctcctgggacctcctgctgctctggctcccagatgccagatgtgacatccagttcgacccagtctccatcctccctgtctgcatctgtggganacagagtcaccatcacttggccgggnagtcgagggcagttggactaatttattagcctggtatcagcagacgaccgaagggaaacctcctaaacctcctagtactctttgctgacatccactctcgcaatcgacgggtcccatctcgattcagtgcagtgatcgtaggacagtattcactctccacntacacgcagcctgcacgtcctagaagcttgtntactaaacttattactagtaactaaaagtataacgcgtcnccgcctactcgtacgttcggacggacggtacgaggtgacgactaaacg

SEQ ID NO: 342851 - DNA, 496 bp, Homo sapiens
  misc_feature: GZ8MTXP02HSPDE.11.70.G04.1.454.CMB.2.raw
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacgttggccgggcgagtcgagggcagttggcaattattagcctggtatcagcagagaccagggaaacctcctaacctcctgatctttgctgcactccactctcgcaatcgacgggtcatctcgattcagtgcagtgatcgtggacagtattcactctccaacatacacacgctgcacgtcctagaaagtntgtactactaacttatactagaaacaaaanacacgcnctcgcctacgtcgtacggtcggaacggacggacgaggtagacgacgtaacgaacg

SEQ ID NO: 342852 - DNA, 523 bp, Homo sapiens
  misc_feature: GZ8MTXP02GJJBT.11.70.G04.1.454.CMB.2.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcgagtcagggcattggcaattattagcctggtatcagcagagaccagggaaacctcctaaacctcctgatctttgctgcatccactctgcaatcaggggtcccatctcgtatcagtgcagtgatcgtgggacagtattcactcncacatcacgcgctgcagcctagaagtatgttgactaacttattacgtagtaacaaaagtaagtaagcgtacctcgccccgtactccgtacggtttaccgggaacggggtaacgggaaccgtaaggggttacggaagtacgtaacgtaaaaaccggg

SEQ ID NO: 342853 - DNA, 430 bp, Homo sapiens
  misc_feature: GZ8MTXP02IFJD6.11.70.G04.1.454.CMB.2.raw
  modified_base (428)..(430): a, c, t, g, unknown or other
  misc_feature (428)..(430): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaaggcccatcggtcttccccctggcaccctcctccaagagcacctctggggcacagcggcccctgggctgcctggtcaggctacttcgtatctctcgctgagcgggctggcaaggcgcatagnnn

SEQ ID NO: 342854 - DNA, 488 bp, Homo sapiens
  misc_feature: GZ8MTXP02JGT0D.11.70.G04.1.454.CMB.2.raw
  modified_base (199)..(199): a, c, t, g, unknown or other
  misc_feature (199)..(199): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcgagtcagggcagttggcaattattagcctggtatcagcagagaccagggaaacctctaacctctgatctttgctgcatccactctgcaatcgagggtcccatctcgattcagtgcagtgatcgtggacagtattcactctacacatcagcagcctgcngccagaacntgtgactaacttatactagtaacaaaagtatacgcgactcgccccgtctcgacgttcggacggacgggtaccgaagggtcggaacgtacgtaaaccg

SEQ ID NO: 342855 - DNA, 497 bp, Homo sapiens
  misc_feature: GZ8MTXP02FF82D.11.70.G04.1.454.CMB.2.raw
  modified_base (200)..(200): a, c, t, g, unknown or other
  misc_feature (200)..(200): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcaggcattggctaattattagcctggtatcagcagagaccagggaaacctcctaaacctcctagtactctttgctgcatccactctcgcaatcgacggggtcccatctcgatcagtgctagtgatcgtgggacagtattcacttcncaccatcancacgctgcagcctagaacgntggttnacttaacttatactgaacaaaagatagcgctccgcccgtactctaggttcggacgggacgggaccgtagggtacggagacgtaaaccg

SEQ ID NO: 342856 - DNA, 573 bp, Homo sapiens
  misc_feature: GZ8MTXP02HPNP2.11.70.G04.1.454.CMB.2.raw
  modified_base (202)..(202): a, c, t, g, unknown or other
  misc_feature (202)..(202): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatccctccctgtctgcatctggtggganacagagtcaccatcacttggccgggcagtcgagggcagttggacaattattagcctggtatcagcagagaccagggaaacctcctaacctctgatctttgctgcatccactctcgcaatcgacggggtcctatctcgtattcagtcgactaggtggactcgtagggactagtacttcacttctacacactcagcagcctgctacgcctaggaagtattggttacacttaaacgtttattaccgttaagtaaacctaaaagtacgttacggaccgtaccgtccgtacccccgtacgttaccggttacggtttaaccggggacgggtaacggggtaacccggtaagggttacggaacgtaacgtaaaacccgg

SEQ ID NO: 342857 - DNA, 494 bp, Homo sapiens
  misc_feature: GZ8MTXP02FU4K3.11.70.G04.1.454.CMB.2.raw
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgagagacagagtcaccatcacttgccggggcagtcagggcagttggcaattattagcctggtatcagcagagaccagggaaacctcctaacctcctgatcttgctgcatccactcctgacaatcgacggggtcccattctcgattcagtgcagtgatcgtgggacagtattcactctacacatacancancctgctagccgtagaagattggttntactaacttattactagtaacaaaagatacgcgactcgccccgntcgaacggtttcggacggacggaccgtaggagaggtaacg

SEQ ID NO: 342858 - DNA, 573 bp, Homo sapiens
  misc_feature: GZ8MTXP02GJ4O6.11.70.G04.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggngagtcagggcattggctaattattagcctggtatcagcagagaccagggaaacctcctaacctctgtatctttgctgctatccactctgcagtcgacgggtcccattctcgattcagtgactaggtgtatcgtagggactagtacttcacttcacactatcagcacgcctgcacgcctagggaactacgttgtacgtactaaactttagttaaccttaggtaaaacctaaaaaggtaacttaacggccgtacgtcccggtacccccgtacgttaccgttacgggtttaaccggggacgggaacggggtaacccggtaaggggttacggaacgtaacgttaaaacccgg

SEQ ID NO: 342859 - DNA, 549 bp, Homo sapiens
  misc_feature: GZ8MTXP02HVYWC.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggnagtcagggcattggcattattagctgtatcagcagagaccagggaaacctcctaaacctcctgatctttgactgcatccactctgcatcgacgggtccatctcgattcagtgacagtgatcgtggacagtattcactctccactactcagcaagtccctgcacgccgtagaacgtagtcgttagactaaactttataacgtagtaaaccgtaaaaagtaacgttaacggactaccgtacgtcccccgtacgttacgtaccgggtttaaccggacggggaaacggggtacccgaaaagggttacgggaacgtaacgttaaaacccgg

SEQ ID NO: 342860 - DNA, 534 bp, Homo sapiens
  misc_feature: GZ8MTXP02GOSE9.11.70.G04.1.454.CMB.2.raw
  modified_base (200)..(200): a, c, t, g, unknown or other
  misc_feature (200)..(200): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcaattatttagcctggtatcagcagagaccagggaaacctcctaacctcctgatctttgctgcatccactctgcatcaggggtcccatctcgntcagtgcagtgatcgnggacagtatttcactctcacatcagcagcctgctagcctagaagtactgttacgactaaactttattacgtacgttaaacaaaagtaactaagtccgtactcggtaccccgtacgttccgtacggtttccgggaccggggaacggggtacccggtaaggggttacggaacggtaagtaaaacccgg

SEQ ID NO: 342861 - DNA, 544 bp, Homo sapiens
  misc_feature: GZ8MTXP02HFG9P.11.70.G04.1.454.CMB.2.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctcctgtctgcatctgtgganacagagtcaccatcacttggccgggcgagtcgaggcattggcaattattagcctggtatcagcagagaccagggaaacctccgtaacctcctgactctttgctgcatccactcncgacatcgacgggtccatctcgattcagtgcagngatcgtggacagtactttcaacttctacactagtcaacgcacgcctgacctacgcctaggtaacagttcgttacgacttaaactttattaccgttagtaaacaaaagtaaatacgacgtccgtaccgacccgtacctacgttaacggttcgggacgggaacgggtaccgttaaagggacggaagtaacgtaaaaccgg

SEQ ID NO: 342862 - DNA, 589 bp, Homo sapiens
  misc_feature: GZ8MTXP02JM5KC.11.70.G04.1.454.CMB.2.raw
  modified_base (200)..(200): a, c, t, g, unknown or other
  misc_feature (200)..(200): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggcgagtcgagggcagttggactaattatttagcctggtatcagcagagaccaggaaccctcctaacctcctgtactctttgcttgctactccactctcgacaacgtcgacggggtcccattctcgtacttcgaggtcgactaggtcgagtcgtagggacctagtactttccacttctaccaccactacacgtacacggcctcgactacgcctaaggaacgtagttgtacgtacttaactttattaccttaggaaaactaaaagtacgttacgaccgtacgtaccgtaccccgacttccggtaacgggtttcggggaccggtaaacggggtaaccggtaagggtacggtaacgacgttaaaaccgg

SEQ ID NO: 342863 - DNA, 510 bp, Homo sapiens
  misc_feature: GZ8MTXP02GN832.11.70.G04.1.454.CMB.2.raw
  modified_base (374)..(374): a, c, t, g, unknown or other
  misc_feature (374)..(374): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattattagcctggtatcagcagagaccagggaaacctcctaactcctgatctttgctgcatccactctcgcaatcaggggtcccatctcgattcagtgcagtgatcgtgggacagattcactctcacatcancacgcctgcagcctagaacgatgttgactaaacttattactgttaacaaaagtaatagacggtactcggacccccgcttccgaggtttccgggacgggtaacgggaaccgaagggttacggaacggactaaaccgg

SEQ ID NO: 342864 - DNA, 511 bp, Homo sapiens
  misc_feature: GZ8MTXP02JGRFW.11.70.G04.1.454.CMB.2.raw
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggcgagtcgagggcattggcaattattagcctggtatcagcagagaccagggaaacctcctaacctcctgatctttgctgcatccactctcgcaatcaggggtcccattctcgattcagtgcagtgatgtggacagtattcactctcacatcagcagcctgcacgcctagaacagtgttanactaattatactagtaacaaaagtatagacgcttaccgcccctacgtaccgtacggttccgggacgggaacggtaaccggaagggtacggaacgaacgtaaaaccgg

SEQ ID NO: 342865 - DNA, 536 bp, Homo sapiens
  misc_feature: GZ8MTXP02HAWNI.11.70.G04.1.454.CMB.2.raw
  modified_base (200)..(200): a, c, t, g, unknown or other
  misc_feature (200)..(200): n is a, c, g, or t
  modified_base (403)..(403): a, c, t, g, unknown or other
  misc_feature (403)..(403): n is a, c, g, or t
  modified_base (483)..(483): a, c, t, g, unknown or other
  misc_feature (483)..(483): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcgagtcgagggcagttggctaattatttagcctggtatcagcagagaccgagggaaacctcctaacctcctgatctttgctgcatccactctcgacaatcgacggggtccatctcgtattcgagtgcagtgatcgtgggactagtactttacactctaccactactcacgcacgccgtnaccgagcctagaacgtagtgttacgacttaaacttattaactagtaactaaaacggaatacggacgtctccgaccccgtntaccgtaggttccggacggtaacgggaccgaaggtcggaacgtacgtaaaccg

SEQ ID NO: 342866 - DNA, 496 bp, Homo sapiens
  misc_feature: GZ8MTXP02FQ020.11.70.G04.1.454.CMB.2.raw
  modified_base (427)..(427): a, c, t, g, unknown or other
  misc_feature (427)..(427): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattattagcctggtatcagcagagaccagggaaacctacctaacctcctgtatctttgctgcatcactctgcaatcagggtccatctcgattcagtgcagtgatcgtgggacagattcactctcacatcagcagcctgcagcctagaagtagtgtgactaacttattactagtaacaaaaagtanagcgtctacgtcccccgtactccgtagtttcggcggtaacgggaccgaaggtacggaagtacaaaccgg

SEQ ID NO: 342867 - DNA, 452 bp, Homo sapiens
  misc_feature: GZ8MTXP02GS26M.11.70.G04.1.454.CMB.2.raw
  modified_base (438)..(452): a, c, t, g, unknown or other
  misc_feature (438)..(452): n is a, c, g, or t
tcagcgagagataccacgaccggtgctcgatttagtgtagtgtgaagggaaagggacgtggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtattgttagggacctccactacggtatggacgtctggggccaagggaccacggtcaccgtctcctcagcctccaccaagggcccatcggtccttcccccgtggcacccctcctccaagagcacctctggggcacagcggccccgtgggctgcctggtcaaggctacttccgtatctctcgctgacgtcgggctggcaaggcgacatagnnnnnnnnnnnnnnn

SEQ ID NO: 342868 - DNA, 532 bp, Homo sapiens
  misc_feature: GZ8MTXP02HRKO4.11.70.G04.1.454.CMB.2.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (433)..(433): a, c, t, g, unknown or other
  misc_feature (433)..(433): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacgttcggccggngagtcgagggcattggcaattattagcctggtatcagcaagagaaccgaaggggaaaaccctcccgtaaacctcctgacttctttagcttgcactccactctgacatcgacggggtccacgtctcgattcagtgcgagtggatcgtggacagtattcactctcacatcagcagcctgcagcctagaactagtgttacgactaacttnttaactagtaactaaaaagacttaagcgtactacgccccgtactcgtacggttaacgggacggaacggaccgaaagggtggaacgaacgttaaaaccgg

SEQ ID NO: 342869 - DNA, 491 bp, Homo sapiens
  misc_feature: GZ8MTXP02JIGQB.11.70.G04.1.454.CMB.2.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggcgagtcagggcattggcaattatttagcctggtatcagcagagaccagggaaacctcctaacctccngtatctttgctgcatccactctgacaatcgacggggtcccatctcgnttcagtgcagtgatcgtggacagtatttcatctacacatcagcagcctgcagcctgaactntgttnactaacttatactgtaacaaaaggacttagacgcctcgcccgactcgtaggttcggacgggacgaccggaggtcgaagactaaacg

SEQ ID NO: 342870 - DNA, 555 bp, Homo sapiens
  misc_feature: GZ8MTXP02IH8VN.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (433)..(433): a, c, t, g, unknown or other
  misc_feature (433)..(433): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcacatcacttggccgggnagtcgagggcagttggactaattattagcctaggtatcagcagagaccgaagggaaaccctacctaacctcctagtacttctttgctgcactcactctcgacaatcgacgggtccatctcgtattcgagtcgacaggtaggtatcgtagggactagtactttcaacttctacacctatacacgcacgcctgcctagcctagaacgtnttagtacgacttaacttattactagtaaactaaaagaacttacggcctacgtaccgacccgtcgtaacgtacgggttcgggacgggaacgggtacgaagggtcggaacgtaacgtaaaccgg

SEQ ID NO: 342871 - DNA, 598 bp, Homo sapiens
  misc_feature: GZ8MTXP02GLNHP.11.70.G04.1.454.CMB.2.raw
  modified_base (202)..(202): a, c, t, g, unknown or other
  misc_feature (202)..(202): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatctgtggganacagagtcaccatcacttcggccgggacagtcgagggctagttggactaaattatttacgccttggtactcagcaagacgaaccgaaacgggtaaaccctcctaaacctcctagtacttcgtttgaaactgacctatcccacttctcgactaatcgaaccgggtcctatctcgtattcgagtcgtcgagtcggtatcggtagggaacctagttactttacacctacttaccaactactacacgcacgtccacgcacgacctagaacgtattcggttatactaaactttataaccgtagttaaaaccgaaaacgagttaacggcctacgtccgtccccgtacgtacggttacggttcggaacgggtaacggacgtagggtagaccgtaaagtaaccg

SEQ ID NO: 342872 - DNA, 535 bp, Homo sapiens
  misc_feature: GZ8MTXP02H1K7K.11.70.G04.1.454.CMB.2.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctcctgtctgcatctgtggganacagagtcacatcacttgccggnagtcgaggcattggcaattattagcctggtatcagcagagaccaggaaacctcctaacctctgtatctttgctgcactccactctcgcactcgacgggtccatctcgtattcagtgcagtgatcgtggacagatttcactctcacatcagcagcctgcagtcctagaagagttggtatactaactttactactacgttaaacaaaagtaacgttaaacgcgtccgtacgtcccccgacttaccgtaacggtttccggggacgggtaacggggacccggtaaacgggtaggtaacggaaacgttaaaacccgg

SEQ ID NO: 342873 - DNA, 484 bp, Homo sapiens
  misc_feature: GZ8MTXP02FX293.11.70.G04.1.454.CMB.2.raw
  modified_base (200)..(200): a, c, t, g, unknown or other
  misc_feature (200)..(200): n is a, c, g, or t
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcgagtcagggcattggcaattattagcctggtatcagcagagaccagggaaacctcctaacctcctgatctttgcttgctatccactctcgacaatcacggggtcccatctgattcagtgcagtgatcgtgggacagtatttcactctcacatcagcagcagcagctagagatgtnctaacttattactataaanaaanaatagacgtctcgccgtacgtcgtacgtaacggacggacggacgaggacggacgacgtacg

SEQ ID NO: 342874 - DNA, 659 bp, Homo sapiens
  misc_feature: GZ8MTXP02JOQ4L.11.70.G04.1.454.CMB.2.raw
  modified_base (200)..(200): a, c, t, g, unknown or other
  misc_feature (200)..(200): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcgagggcagttggactaattattagccttggtatcagcagagaaccagggaaaccctccgtaacctcctgtacttctttagctgctactcctactctacgctaaacgtcgacggggtcccattcctcgtaactttcgaggttgaccgtagggtcggtactcgttacggggaatacgtactttaccacttacctaccaacctaactcaacgtcctaaacggcccttgaccgaacgtccgttaacggaaacgtagttacgggttacgtaccttaaaacttttacgtttaacctaaggtaaaacctaaaaacgtaagttacggaacccgtacgttacccggtccccgtaccgtttaccggtacggtttaaccggggaacggggttaaccgggaacccggtaaggggttaccggaaggtaacgtaaaacccggg

SEQ ID NO: 342875 - DNA, 654 bp, Homo sapiens
  misc_feature: GZ8MTXP02HEMCL.11.70.G04.1.454.CMB.2.raw
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccacttccctccctgtctgctatcgtggtgggagacagacgtccaacctatcctacgttcggccgggcgaggtcgaggctagttggactaaatttacgttagccgttaggtactacgacggacaacggaacgaaccgaaacgggtaaaccccttacccgtaaccctctagtacttctttgctagccactccactcacgactaacgtcgtaccggtcctacgtctcgtacttcgagtcgcgtaggtcggacgtcgtacggactacgtacttctactctaccactacgacgacgtccacgtctacgaccgacgtaccgtaagtaagtacgttacggttacgtaacctttaaactttaactttaacgtaaagtaaaaccgtaaaagtaccgtacggtccgtccggaccgtcccgtacgttacggtaccgggttaacgggacgggtaacgggacggtaacgggtagaacgttaaccggaaacgg

SEQ ID NO: 342876 - DNA, 520 bp, Homo sapiens
  misc_feature: GZ8MTXP02G5GBJ.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggngagtcagggcattggcaattattagcctggtatcagcagagaccagggaaacctcctaacctcctgatctttgcttgcatccactctcgcaatcaggggtcccatctcgattcagtgcagtgatcgtgggacagattcactctcacatcagcaagcctacacgcctagagatgttcgactaacttattactagtacaaaagtaactagacgcctacgacccccggtctaccgtacggtttaccgggaacggtaacggggaacccgaaggggtaggaacgtaacgtacgaaaaaccgg

SEQ ID NO: 342877 - DNA, 490 bp, Homo sapiens
  misc_feature: GZ8MTXP02G77V4.11.70.G04.1.454.CMB.2.raw
  modified_base (353)..(353): a, c, t, g, unknown or other
  misc_feature (353)..(353): n is a, c, g, or t
  modified_base (439)..(439): a, c, t, g, unknown or other
  misc_feature (439)..(439): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctcgcaatcaggggtcccagtctcgattcagtggcagtgatcngggacagatttcactctcaccatcagcagcctgcagcctgaacgatgttgcaaacgtttattactagttacaaaagaactagaccncgtcgacccgctctagttcggacggtagggaccaaggtcggagactaaacg

SEQ ID NO: 342878 - DNA, 495 bp, Homo sapiens
  misc_feature: GZ8MTXP02JNE4R.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcgagtcgaggcattggcaattatttagcctggtatcagcagagaccagggaaacctcctaacctcctgatctttgctgcatccactctcgcatcacggggtcccatctcgattcagtgcaggtgatcgtagggacagtatttcactctccacatcagcagcctgcagcctagacgagtgtacacgtaacttattactagtaaacaaaagtaatagcgactcgcccgtactcgacgttcggacggacggaccgaggtacggacgacgtaaacg

SEQ ID NO: 342879 - DNA, 438 bp, Homo sapiens
  misc_feature: GZ8MTXP02JBGGZ.11.70.G04.1.454.CMB.2.raw
  modified_base (433)..(438): a, c, t, g, unknown or other
  misc_feature (433)..(438): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtattgttagggacctccactacggtatggacgtctggggccaagggaccacggtcaccgtctcctcagcctccaccaagggcccatcggtcttccccctggcaccctcctccaagagcacctctggggcacagcggccccctgggctgcctggtcatgggactacttccgtatctctcgctgagcgggctggcaaggcgcatagnnnnnn

SEQ ID NO: 342880 - DNA, 642 bp, Homo sapiens
  misc_feature: GZ8MTXP02IFLP5.11.70.G04.1.454.CMB.2.raw
  modified_base (202)..(202): a, c, t, g, unknown or other
  misc_feature (202)..(202): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtctccatcctccctgtctgcatcgtggtggganacagagtcacatctacgtggccggcgagtcgaggcagttgactaattattacgctgtactcagcagacgaccgaacggtaaccctacctaacctctagtacttctttagctgactactccactctcgactaacgtcgacgggtccattctcgtacgttcgaggtcgactagggtacgtacgtcgtagggactacgttactttactaccgttcctaccacctacgtaccgacgaccgacgtccgtacgacgtaccgtaccgtaggaaacgttgttacgttacgtaacctttaaactttaacgtttaacgtaacgttaaaacgtaaaagtacgttacggaccgttccgtacccgtaccccgttaccgttacggttaccggggtttaaccgggaacgggtaaaccgggttaccggaaggttacggaaacgtaacgtaaaccgg

SEQ ID NO: 342881 - DNA, 627 bp, Homo sapiens
  misc_feature: GZ8MTXP02IS21X.11.70.G04.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccgggngagtcgagggcagttggactaatttattagcctggtatcagcagagaccacgggaaacctcctaacctctgtattctttnctgctatcctactctcactaagtcgtaacggggtcccctattccgtcgtactttaccgaggttcgaccgtaggttcgggtaacttccggtagggaacgtacgtactttcctaaccttcttacccacctatacgacgcgtacgcccttgggactaaccgtccgtaggtaaaccgtaagttcgttaggtacttaaaactttattaaccgttaagtaaacgtaaaaacgtactaacgggtactaccgtccggtaccccgtcgtacggttacggtttccgggacgggacgggtaaacggagggtacggacgtaacgtaaaaccgg

SEQ ID NO: 342882 - DNA, 497 bp, Homo sapiens
  misc_feature: GZ8MTXP02JW3D4.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtcctccatcctccctgtctgcatctgtggganacagagtcaccatcacttgccgggngagtcagggcattggcaattatttagcctggtatcagcagagaccagggaaaccctcctaacctcctgactctttgctgcatccactctcgacaatcgacgggtcccatctcgattcagtgcagtgatcgtgggacagtactttcacttctcacatcagcagcctgcagctagaantgtnactaacttatactgtaacaaaagtatagcgactcgaccccgctacgtaggttcggacggaacgggaccgaagggtcggaagacgtaaacgg

SEQ ID NO: 342883 - DNA, 521 bp, Homo sapiens
  misc_feature: GZ8MTXP02JIHMK.11.70.G04.1.454.CMB.2.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcaattatttagcctggtatcagcagagaccagggaaacctcctaacctcctgattctttgctgcatccactctcgcaatcgacggggtcccattctcgtatcagtcgcagtcggatcgtgggacagtntttcactctacaccatcancagcctgcagcctaggaactatgttacgactaactttattacgtagtaacaaaaagtaactacgcgtactaccgccccgtacgtcgtacggtttcggacgggtacggaaccgtaggtacggaacgacgtaaaccg

SEQ ID NO: 342884 - DNA, 667 bp, Homo sapiens
  misc_feature: GZ8MTXP02JNZAH.11.70.G04.1.454.CMB.2.raw
  modified_base (205)..(205): a, c, t, g, unknown or other
  misc_feature (205)..(205): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccactccctccctgtctgcatctggtggganacagacgtcaccatcacgttcggccggcgagtcgagggctagtggctaattattacgccttggtatcagcaagacgaaccgacgggaaaccctcctaacctcctgacttctttgactgctactcctactctcgactaacgtcgaacggggtcccattctcgtacttcgtacggtggtcctaggtgacgttaccggtgggtaactaacggttactttacccgtaccttaccttacccaaccctacgtaccacgggtacctaaccgccgttaacgccgtaacgtacccgttagaaacgtacgttacgtacggtacttaaactttaccgtaagttacgtaaaacgtaaaacgtacgtacgaaccggtcctaccggtaccccgttacgtacggttaccgggttaacggggacggggtaaaccggaaacggtacggggtaacgtaaacggtaacgttaaaacccggg

SEQ ID NO: 342885 - DNA, 621 bp, Homo sapiens
  misc_feature: GZ8MTXP02I879K.11.70.G04.1.454.CMB.2.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (352)..(352): a, c, t, g, unknown or other
  misc_feature (352)..(352): n is a, c, g, or t
  modified_base (447)..(447): a, c, t, g, unknown or other
  misc_feature (447)..(447): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctcctgtctgcatctggtggganacagacgtcaccatctacgttggccggnagtcgagggctagttggactaatttacttacgccttaggtatcgagacaggaacgaaccgaagggtaaacccctccctaaccttccgtagtacttcgtttacgctcgacctactccacttcncgactacgtcgacggtccagtctcgtatcgagtcgactaggtgacgtcgtacgggtactagttacttactctcctcactatccagcacggtcccngaccgtagccgtaaggtaaacgtgttacggttactaccttaaaacgtttacttaacgttaacggtaaaactaaaaagtacgttaacgaccgtcccgtaaccgtcccgtacgttaccggtacgggttccgggacgggaacggtacgtaagggtacggaacgttaacgaaaaccgg

SEQ ID NO: 342886 - DNA, 579 bp, Homo sapiens
  misc_feature: GZ8MTXP02GN17H.11.70.G04.1.454.CMB.2.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (394)..(394): a, c, t, g, unknown or other
  misc_feature (394)..(394): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtcctccatccctccctgtcctgctatcgtggtaggganacagagtcacatcacttggaccggcgagtcgagggcngttggctaattattagcctggtatcagcaagacaccgaaggtaaaccctcctaaacctcctagacttctttagctgacctatccactctagacaacgtcgtaacggggtccctattctcggatttcgaaggttcgacgtgtggacttcgnggactgtaacttcaacttcacctacaactcgacncacgtccnggacacgccgtagaaagtgttcggtataacttaaaccgtttataaccgtntaaaacgtaaaatagtaacgcgttacnccgccccgtagtactcgggttaacggacggaacgggtaaccaaggggtagaacgtaacgtaaaccg

SEQ ID NO: 342887 - DNA, 494 bp, Homo sapiens
  misc_feature: GZ8MTXP02IXKVE.11.70.G04.1.454.CMB.2.raw
  modified_base (402)..(402): a, c, t, g, unknown or other
  misc_feature (402)..(402): n is a, c, g, or t
tcagcgagagataccacgaccggtgctcgatttagtgtagtgtgaagggaaagggggcagaagtctctctcagtcaggacacagcatggacatgagggtccctgctcagctccctgggactcctgctgctctggctcccagatgccagatgtgacatccagttcgacccagtcctccatcctccctgtctgcatctgtgggagacagagtcaccatcacttggccgggcagtcgagggcattggcaattattagcctggtatcagcagagacaggaaacctcctaacctcctgattctttgctgcatccactctgcatcagggtcccatctgattcagtgcagtgatcgtggactagtattcactctcacatcacgcagcctgctacgcctagaagctggtnactaacttattactgtaacaaaagataagcgacgttcgccccgtctcgtaaggttcggcgggtaggaccgaaggtcggacgacgtaaaccgg

SEQ ID NO: 342888 - DNA, 747 bp, Homo sapiens
  misc_feature: GZ8MTXP02JAMVP.11.70.G04.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtcctccatcctccctgtctgcatctgtggganacagatcaccatcacttggccgggngagtcgagggcagttggcaattattagcctggtatcagcagagaccagggaaacctccgtaacctcctagtacttctttacgctgacctactcccacttctcgacctaagtccgtaacggggtccccacgttccgtcggtactttacgaacgggttcgggaccgtaagggttacgggtaacgttacccggtagggggtaacccgtaacgggttaacgtttttacccgtaacccgtttacccgttaccccgtaaacccgtaactttacccgtaaacggacccgtaaaccggtccccgtttacggacccgtaacggtacccgtaagggtaaacgtaccgtttagggttacgtaaccgtttaaaacctttacgttaaaccgttaacgttaaaacctaaaaaaggtaacgttaaacgggcccgtaaaccgtcccggtacccccgttacgttaccgttaacgggtttccgggacggggttaaacgggaacccggtaaagggttacggaacgtaacgttaaaaccgg

SEQ ID NO: 342889 - DNA, 587 bp, Homo sapiens
  misc_feature: GZ8MTXP02F9IBG.11.70.G04.1.454.CMB.2.raw
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacgttggccgggcgagtcgagggcattggctaattatttagcctggtatcagcagagaccagggaaacctcctaacctcctgtatctttgctgcatccatctgcaatcgacgggtcccatctcgatcagtgcgagtgatcgtagggactagtacttacactctccactaatcgaacgcaacggtccctcggactacgccttaggaagtatggttactactaaactttatacgttagtaactaaaaaggtaacttacggaaccgtaccgttacggcccccgttacgttaccggtaaccggtttaacgggggaacccgggttaaacggggtaaacccgaaaagggggttacggaaaacggtacgtaaaaacccgg

SEQ ID NO: 342890 - DNA, 696 bp, Homo sapiens
  misc_feature: GZ8MTXP02GQPQY.11.70.G04.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagacgtcaccatcacgttggccgggngagtcgagggcagttggcaattattagcctggtatcagcagagaccgacgggaaacctcctaaacctcctagtacttcgtttagctcgtcactcctacgtctcgacatcgacggggtccatctcgtatcaggtcgcgtaggtgtacgtcgtagggaacctaggtactttacccacttacctcctaacctacgttacgaaacgtccgtaaaccgcccgttacgaccgtacggtaccccgttaagggtaaaccgttaagttacgtttacggtaaccgttaaaaccttttaatttaaccgttaacggttaaaaccgtaaaaaaaggtaaccgttaaacggtaacccgttacgtaaccccggtccccgtaaccggttacccgttaaacggggtttaacccggggaccggggttaaaccggggaaacccggtaaagggggtaacgggtaacggtaaacgttaaaaacccggg

SEQ ID NO: 342891 - DNA, 564 bp, Homo sapiens
  misc_feature: GZ8MTXP02GJ8YR.11.70.G04.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctggtggganacagagtcaccatcacgttggccggngagtcgagggcagttggactaattattagccttggtatcgagcaagacgaaccgagggtaaaccctcctaacctcctagtacttctttgctcgcactccactctcgacatcgacggtccatctcgtattcgngtcgntagtgatcgtggacagtattcactctacacatcgacgtcacgcctagctagccgtagaagtcgttacgtacgtaacttaaacgtttattaaccgtagttaaaacgaaaacgtagtaacgtcgtacgtacccgcccgtacgttaccgtacggttccgggacggaacgggtaaccgaagggtacgtacgaacgtaaaaccgg

SEQ ID NO: 342892 - DNA, 564 bp, Homo sapiens
  misc_feature: GZ8MTXP02G8Z5A.11.70.G04.1.454.CMB.2.raw
  modified_base (201)..(201): a, c, t, g, unknown or other
  misc_feature (201)..(201): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtcctccatcctccctgtctgcatctgtggganacagagtcaccatcacgttggccgggcagtcgagggcagttggacaattatttagcctggtatcagcaagacgaccaagggaaaccctccgtaacctcctagtattctttgctgctatccactctcgcatcgacgggtccatctcgattcgagtgcaggtgatcgtgggactagtattacactcnccactactcgancacgccagtcagcctaggaacgtntgttacgactaactttaattaccgtaagtaactaaaaagtaacgttacgacgtccgtaccgcccgtacgttaccgttacgggtttaaccgggcggggtaaccgggtacggtaacgggtacgggaacggaacgttaaaaccgg

SEQ ID NO: 342893 - DNA, 504 bp, Homo sapiens
  misc_feature: GZ8MTXP02IESYR.11.70.G04.1.454.CMB.2.raw
  modified_base (200)..(200): a, c, t, g, unknown or other
  misc_feature (200)..(200): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccggcgagtcagggcattggcattattagcctggtatcagcaagagaccagggaaacctcctaacctcctgactctttgctgcatccactctgcaatcgagggtcccatctcgattcagtgcagtgatgtgggacagtattcactcncacatcagcagcctgcagcctgaaangtagtcgactaacttattactgtaacaaaaagtatagaccgtactacgccccgtactccgtacgttccgggacggtaacgggaccgaagggtacggaacgaacgtaaaccgg

SEQ ID NO: 342894 - DNA, 576 bp, Homo sapiens
  misc_feature: GZ8MTXP02H1Y98.11.70.G04.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (402)..(402): a, c, t, g, unknown or other
  misc_feature (402)..(402): n is a, c, g, or t
  modified_base (490)..(490): a, c, t, g, unknown or other
  misc_feature (490)..(490): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggcctcccagatgccagatgtgacatccagttcgacccagtctccactcctccctgtctgcatctggtgganacagagtcaccatcacgttcggccgggnagtcgagggcagttggctaattattacgcctggtatcagcagagaccgaacgggaacctcctaaacctctgtattctttgcttgctatccactctcgacaactcgaacggggtccattctcgtacttcagtgcgtagtgatcgtaggactagtctttcaactctactacanacacgcacgctcgactaggccttagagtattgtacgtactaacttattaactagtaaaacgtaaaacagttaaacgcgtaccgtaccncccgtaacttcggtacgggtttaaccgggaccgggtaaacggggtaacccgtaaacggggacggttaagaaaacgttaaaacccgg

SEQ ID NO: 342895 - DNA, 566 bp, Homo sapiens
  misc_feature: GZ8MTXP02GI3DC.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcatattagcctggtatcagcagagaccagggaaacctcctaaccgtcctgatctttgctgcatcactctcgcaatcaggggtccatctcgactcagttgcagtggatcgtggacagtattcactctacacactcaagcaggcctgacgagccctagagtaagtgtttacgactaaacttattaaccttggtaaacctaaaacgtaaagttaaacgccgttaaaccgtaccgcccccgtaaccgttccgttacggttttaaccggggtaccgggtaacgggggaaccccgtaaaggggtttacgggaaaggtacgtttaaaaacccggg

SEQ ID NO: 342896 - DNA, 702 bp, Homo sapiens
  misc_feature: GZ8MTXP02H1ION.11.70.G04.1.454.CMB.2.raw
  modified_base (200)..(200): a, c, t, g, unknown or other
  misc_feature (200)..(200): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtgganacagagtcaccatcacttggccggcgagtcgaggcattggctaattattagccttggtatcgagcaggacgaccgaaacgggtaaaccctaccgtaaaccctcctagtacttctttagcttgacactcccgactctcgactaacgttcgacgggttcccagttcctcggtacttcgaacggtcgacgtaggtaggtaacgttcgtaggggtaacctaaggttactttaccaaccgtttaccttacccaacctaacgttaccgacgccgtaaaccgggtcccttacggaccgttaaccggtacccgtaaggtaaacggttacgttacgggttaacgttaccgttaaaacttttaacgtttaaaccgtaagtaaaaccgtaaaaagtaacgtttaaaccggccgttaaccggtccgtaccccgtacttaacccggttacggtttaacccggggacgggaaaccgggtacccggtaagggtaaccgggtagtaaacgtaaaccgg

SEQ ID NO: 342897 - DNA, 525 bp, Homo sapiens
  misc_feature: GZ8MTXP02ID4YD.11.70.G04.1.454.CMB.2.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatcctccctgtctgcatctgtggganacagagtcaccatcacgttggccgggcagtcgagggcattggactaattattagcctggtatcagcaganaccgaagggaaacctcctaacctcctgtatctttgcttgcactccactctcgacaatccgagggtccatctcgattcgagtgctagtgactcgtgggactagtacttcacttctacactatcagcacgtcctgactagccgttagagaagttggttactactaaactttattacgtagttaaacaaaagactggaactcgcgccctcttacgtaggttccggacggtacggaccgaggngaacgtanaaaccg

SEQ ID NO: 342898 - DNA, 799 bp, Homo sapiens
  misc_feature: GZ8MTXP02JWEIN.11.70.G04.1.454.CMB.2.raw
  modified_base (203)..(203): a, c, t, g, unknown or other
  misc_feature (203)..(203): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtcctccatccctccctgtctgcatcgtggtgganacagcgtcaccatctacgttcggccggcgagtccgaggctagttggactaagtttattagccttaggtatcagcaagacgaaccaacgggtaaaccctacctaaccgtcctagtacttcgtttcgctacgcctactaccctcgttactacccggacctaacgttaccgggaccggggttacccctaacgtttccgttaccgttaacgttaccggttaacgggttcggaccgttacggggtaggtacgttaaccgggtacggggtaaaccctttaagggttaacccttttaccgtaaaccccgttccgtttaacccccgtaaacccgaacctttaccgtaaacccggtcctaaaacccggggcccctttaaacgggtacccggtaaccggacccgtttaaacgggtaaagttaccggtttaacggttacgtaaaccccgtttaaagtttaaacttaaccgtaaagtaaaaccgtaaaaaggtaacgtccggtaccgtacccgttaacccgggcccctacggttaaccgttacggggtccggtaacgggggtaaccgggaccgtaaacggggttaggaacgttaaacgtaaaacccgg

SEQ ID NO: 342899 - DNA, 658 bp, Homo sapiens
  misc_feature: GZ8MTXP02HSYR5.11.70.G04.1.454.CMB.2.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (405)..(405): a, c, t, g, unknown or other
  misc_feature (405)..(405): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccacttccctcctgtctgctatcgtggtgganacgagagtccacctatctacgttcggccgggngagtcgagggctagttggactaatttagttacgccgttaggtactcgagacgaaggaacgaacccgaaacgggtaaaccccttccctaaacccgtccgttagtactttctttgcttcgctaactcctactcgtacgactaacgtcgtacgggtccattcgtctatcgnggtcgtacaggtcgtacgtcgtaggactagtacttaccacttcctaccactacgtacacgtaccacgtccgacgtacgacgtcgtagaacgtagttacgttacgtaactttaaacttacgttaaacgtacgtaaaacgtaaaagtacgttacggaccgttaccgcccgtacccgtacgttaccggttacggttaaccgggggacggtaaacgggtaccggtaaagggtacgtaaacggtaaaccgtaaaacgg

SEQ ID NO: 342900 - DNA, 657 bp, Homo sapiens
  misc_feature: GZ8MTXP02GG3M8.11.70.G04.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (457)..(457): a, c, t, g, unknown or other
  misc_feature (457)..(457): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctggtggganacagagtcacatcacgttggccggnagtcgaggcatggactaattattagcctggtatcagcaagagaaccaagggaaaccctaccgtaaacctcctagtacttctttacgctcgacctactacctaacttcctacgacctaacgtccggaacggggttccccaattccgtcgtattccgaaggttcggacgtaggtggtacgtcgtagggactaacgttatttcacttacctacaaccatcacgcacgtcccgngaccacgtacctaggtaaagtacgtttaggttacgtaaccttaaacttttacttaaacgtacgttaaaacgaaaaagtaacgtaaacggttcgaccgttcccgtacccccggtacttcggttaacgggtttcccgggggaacgggaaccgggggtaaaccggttaagggggtaacgggtaacgaacgttaaaaacccggg

SEQ ID NO: 342901 - DNA, 561 bp, Homo sapiens
  misc_feature: GZ8MTXP02I2R0M.11.70.G04.1.454.CMB.2.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcaccatcacgttggccggngagtcgagggcattggctaattattagcctaggtatcagcagagaccgagggaaacctcctaaacctcctagaacttctttgctgcactccactctcgacaacgtcgacgggtcccatctcgtattcgagtgcgtaagtgatcgtggactagtatttcactctaccacactcacgcacgcctgacagcctagaagtctgttagactaacttatactagtaaacaaaagtaagtacgacgtaccgtccggaccccgtacgttccggtacggtttaaccgggacgggtaaacgggaacccggtaaggggtacggtaaacgaaccgttaaaaaccgg

SEQ ID NO: 342902 - DNA, 506 bp, Homo sapiens
  misc_feature: GZ8MTXP02JZ2C4.11.70.G04.1.454.CMB.2.raw
  modified_base (199)..(199): a, c, t, g, unknown or other
  misc_feature (199)..(199): n is a, c, g, or t
  modified_base (386)..(386): a, c, t, g, unknown or other
  misc_feature (386)..(386): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcagggcattggcaattattagcctggtatcagcagagaccaggaaacctccaacctctgatctttgctgctactccactctgctaatcgacgggtccatctcgattcagtgcagtggatcgtaggacagtatttcactctcaccatcagcagcctgcanccgtagaagtattgttacgactaacttattactgtaaactaaaagtaatacgccgactccgacccgcgtaccgtaggttccgggacggaacgggaccgaagggtcggaacgactaaacgg

SEQ ID NO: 342903 - DNA, 665 bp, Homo sapiens
  misc_feature: GZ8MTXP02ISH5V.11.70.G04.1.454.CMB.2.raw
  modified_base (203)..(203): a, c, t, g, unknown or other
  misc_feature (203)..(203): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatctggtggganacagagtcaccatcacgttcggccgggacagtcgagggctagttggactaatttattacgccttggtatcgagcagacgaccgaacgggtaaaccctccgtaaaccctcctagtaacttcgtttacgctcgactacctacccaacttctccgactaacgtccgaacggggttccctattacgtcggtaatttccgaaggttcggacgtaggtggaacgtcgttaggaaccttaagtactttaccaccttacctacctaaccaacgtacaacgctaaccgtaccgtcgacccgtacgacccgttaacggaacgtacgttaggtaccgtaacttaaactttaacgttaaccgtaaggtaaaactaaaaagtaacgttaacgccgtaccgttccgaccccgtacgttacgtacgggttaaccgggacggtaacggaccggtaaggacggaacggactaaaaccgg

SEQ ID NO: 342904 - DNA, 532 bp, Homo sapiens
  misc_feature: GZ8MTXP02ICR7O.11.70.G04.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (316)..(316): a, c, t, g, unknown or other
  misc_feature (316)..(316): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtgganacagagtcaccatcacttgccgggngagtcgagggcagttggcaattattagcctggtatcagcagagaccagggaaacctcctaaacctcctgtatctttgctgctatccactcncgacaagtcaacggggtcccatctcgtattcaaggtgcgtagtgatcgtggactagattcactcncacatcagcanccctgccgacgccttaggaaacgtagttcgtagtactaaactttgttaactagtaactaaaacgatagccgtactcgacccgtctaccgtacggttccggacggtaacggaccggaaaggtggaaacgtacgtaaaaccg

SEQ ID NO: 342905 - DNA, 630 bp, Homo sapiens
  misc_feature: GZ8MTXP02IA18F.11.70.G04.1.454.CMB.2.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (355)..(356): a, c, t, g, unknown or other
  misc_feature (355)..(356): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccactcctccctgtctgcatctggtggganacagagtcacatcatggccggnagtcgagggcatggcaattattagcctgatcagcagagaccagggaaacctcctaacctctgtattctttgctgcactaccnctctcgacaacgtcgacgggtccactctcgtattcagttgactaggtnntacgtggactagtacttcgacttactcaacctacgcacgcaaacgtccgtacgacgtacgacccgttaggaaagttacgttccggttaagtaacccgttaagtttttaaaccttaagttaacgttaaaaccgtaaaaacgtaaagtttacggaaaccgtttccggacccggtaccccgtacgtttacccgttaacgggggtttaacccgggaacggggttaaaccggggaacccggtaaaggggttacggaaacgggttaaactaaaacccggg

SEQ ID NO: 342906 - DNA, 717 bp, Homo sapiens
  misc_feature: GZ8MTXP02HBW14.11.70.G04.1.454.CMB.2.raw
  modified_base (199)..(199): a, c, t, g, unknown or other
  misc_feature (199)..(199): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtctccatcctcctgtctgcatctggtgganacagatcacatcacgttggccgggcgagtcgagggcagttggacaatttattacgccgtaggtatacagacaaggaacgaacccgaaacggggtaaacccctaccctaaaccctaccgtacgtaacttctttcggtcttacgactacctcctaactcgtacgtactaaacgtccgtaacgggggtcccctaattccgttccgtattcgaacggttcggaccgtagggtaggtactacgttggggaactaaggtactttacgtaccttacctaccaccttaactaccaacgtaccgacgtccggtacacggtacgtacgtaacggaagttaggttacttacggtaaacccttaaagtttaacccttaaagtaaaccgtaaaacgtaaaagttaaacgttacgggaccctaacggttaccccgcccgttaccggttaccggttaacggggttccggggaaccgggttaaacgggggaaaccggttaaggggtacggaaacggttaaccgtaaaaaccggg

SEQ ID NO: 342907 - DNA, 490 bp, Homo sapiens
  misc_feature: GZ8MTXP02FJW2T.11.70.G04.1.454.CMB.2.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttggccgggagagtcagggcattggcaattattagcctggtatcagcagagaccagggaaacctcctaacctctgatctttgctgcanccactctcgcaatcaggggtcccatctcgatcagtgcagngatcgtggacngattcactctcacatcatcancctgcagcctagaagatgttagactaacttaatactagtaacaaaagtaatagtcgctacgccccgtcgtctacggttcggacggtacggaccgaaggtacggagactaaaccg

SEQ ID NO: 342908 - DNA, 486 bp, Homo sapiens
  misc_feature: GZ8MTXP02JQYA6.11.70.G04.1.454.CMB.2.raw
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccggcgagtcagggcagttggacaattattagcctggtatcgagcagagaccagggaacctcctaacctctgatcttgctgcatccactctgcaatcacgggtccatctcgtattcagttgcagtggactcgngggacagatttcactctcacatcagcacgctgcagcctagagatntgactacttagttactagtaacaaaagtanacgcgtctacgccctcncgtacgttcggacggacggaccgaggtacgacgtacgtaacg

SEQ ID NO: 342909 - DNA, 627 bp, Homo sapiens
  misc_feature: GZ8MTXP02FPTP2.11.70.G04.1.454.CMB.2.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (443)..(443): a, c, t, g, unknown or other
  misc_feature (443)..(443): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcacntcacttggccggcgagtcgaggctattggactaattattagcctggtatcagcagacgtaaccgaacgggtaaaccctaccctaacctcctagtacttcctttagccttcgtctactccctaaccgtctaccgtacctaaacgtacgtaccggggttaccctaacgttccttcggtacttcgaaggtcggtcgtaggtgggtactcgtaggactagtactttactacttacnccaccgtactcacgcacgcctcgcacgtctagaagtctgtacgaacttaacttacttactagttaaaccaaaagtaacgacgtaccgtccgtacccgcccgtacgttaccggtagggtttcccggggaacgggtaacgggtaccggtaaacggggttaacgggaacgtaacggtttaaaaccgg

SEQ ID NO: 342910 - DNA, 580 bp, Homo sapiens
  misc_feature: GZ8MTXP02H6GHF.11.70.G04.1.454.CMB.2.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (382)..(382): a, c, t, g, unknown or other
  misc_feature (382)..(382): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttcgacccagtctccatcctcctgtctgcatctgtggganacagagtcacatcacgtggccggnagtcgagggcattggcaattattagcctgtatcagcagagaccagggaaacctctaacctctgtatctttgctgcatccactctcacatcgacgggtccatctcgtattcaggtgaccgagtgagtcgtagggactagtaacttcactctacacatcancagcctgacgtagaccgtagaagtacgttaggtataccttaaaactttatttaaccgtagtaaaccgtaaaaagtaacgttaacgacgtacccgtaccggtacccccgtacgttaccgttaaccgggtttaaccggggaccggggttaaacgggaacccggtaaaggggtacgggtaaacgtaacggttaaaacccgg

SEQ ID NO: 342911 - DNA, 520 bp, Homo sapiens
  misc_feature: GZ8MTXP02G5GWJ.11.70.G04.1.454.CMB.2.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtcctccatcctcctgtctgcatctgtggganacagagtcacatcacttgccggcgagtcgagggcattggctaattatttagccttggtactcagcagagaccagggaaaccctcctaacctcctagattcctttancttgccatccactctcgactaatcgacggggtcccagtcctcgattcacgtgctaggtgaactcgtagggaccagtactttcactctacactatcagcagcctancagcctagaacgtntagtcactattacttacgtataactaaaacganacgcgtctccggccctactacgtacggtcggacggaacggacgtaggacgtacgacgtaacg

SEQ ID NO: 342912 - DNA, 594 bp, Homo sapiens
  misc_feature: GZ8MTXP02JGAR7.11.70.G04.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatcctcctgtctgcatctggtggganacagacgtcaccatcacgttggccgggngagtcgaagggctagttggctaattattagcctggtactcgagcagacgaccgaagggtaaaccctccgtaacctcctgacttctttgctgcactccactctacgacatcgacggtccattcncgattcagtgcaggtgactcgtggacagtacttcaactctacacagtcagcacgcctgcagtcctagaagtcttaggttacacttaaactttagttaaccgtaagtaaaacgtaaaaagtaacgtaacggtaccgtaccgttccggacccccgttacgttaccggttacggtttaaccgggggaccgggtaaacggggaaacccgtaaggggtaaccggtaaacgtaacgttaaaaacccggg

SEQ ID NO: 342913 - DNA, 691 bp, Homo sapiens
  misc_feature: GZ8MTXP02IYRMI.11.70.G04.1.454.CMB.2.raw
  modified_base (201)..(201): a, c, t, g, unknown or other
  misc_feature (201)..(201): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatccctcctgtctgcatctggtggganacgagacgtcaaccatcacgttcggccggcgagtcgagggctagttggactaattattacgccgtaggtatacgagacaaggaacgaccgaacgggaaaccttaccctaaacctcccgtagtacttcgtttagtcgttgacctactccaactctccgactaacgtccgtacggggtaccctacgttccgtcgtatttcgacggtcggacctaagggtggtacgttccggtaggggtaacctaggttactttaccaaccgttcttaccaacctacttaccgacgactacgccttcggacctacgtacctaacggtaagtagtttacggttactaacgttaaaccgtttaattaaccgttaaggtaaaacctaaaaagtacgttacggtaccgtacgtcccggttaccccgacgttaccggttacggggttcccgggacgggtaaacccggggtacggtaaagggtacggtaacgtaaaaccgttaaaccgg

SEQ ID NO: 342914 - DNA, 653 bp, Homo sapiens
  misc_feature: GZ8MTXP02IW8YV.11.70.G04.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctggtggganacagagtcaccatcacttggccggngagtcgagggcagttggactaatttagttagcctggtatcagcagagaccagggtaaacctcctaacctcctagacttctttcgctgactactccactctcgacacgtcgacgggtccattctcgattcaggtgcgtaagtgacgtcgtagggaactagtactttcctactacttaccaacctataccgaacgtcgaaccggcctaggactacggtaccctaggtaaagtagttcggttaacgtaaccttaaaacgttttaacttaaccgtttaacggaaaaccttaaaaaaggtacgtttaaacggccggtaccgtaacccggtacccccgttcgttaacccggttacggggtttccggggaaccgggttaaaccggggaacccggttaaagggggtacggaaacgtaacgtttaaaaacccggg

SEQ ID NO: 342915 - DNA, 644 bp, Homo sapiens
  misc_feature: GZ8MTXP02GFGUF.11.70.G04.1.454.CMB.2.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatccctccctgtctgcatcgtggtggganacagacgtccacctatcacgttcggccgggngagtcgagggctagttcggactaattatttacgccgtaggtactacgagacgaaggacgaacccgaaacgggtaaacccctaccctaaaccgtcctagtacttctttcgctcgactactcctaccttctaccgtactaacgtcggacgggtccctacgttctcgtataccgtaggtcgtcgtagggtcgagtacgtaggtaacctagttacttccacttcctacctactaacgtcaacggcacgtaccgtcgaccgtacgtaccgtagtaagtacgttacggttaacgtaaccttaaattacggttaactacgtaaaacgtaaaagtacgtacggtccgtaccgtccggacccgtcgtacgttacgggtaacggacggacggtacgaggtacgaacgtacgtaaaccgg

SEQ ID NO: 342916 - DNA, 653 bp, Homo sapiens
  misc_feature: GZ8MTXP02IGKSS.11.70.G04.1.454.CMB.2.raw
  modified_base (129)..(129): a, c, t, g, unknown or other
  misc_feature (129)..(129): n is a, c, g, or t
  modified_base (200)..(200): a, c, t, g, unknown or other
  misc_feature (200)..(200): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctntggctcccagatgccagatgtgacatccagttgacccagtctccatccctccctgtctgcatctgtggganacagacgtcaccatcacttggccgggcagtcgagggcagttggctaattattagctggtatcagcagagaccaagggaaaccctacctaacctcctgacttctttagctgcactccacgtctacgcaactcgagggtccctagttctcgtattcgacgtcggtactaggtcggtactacgtacgggaacgtagttaacttttacaacctttcctacctaaccacttaccacgtacgaccgtaccctggaccagcccttaaggaagttacgtcggtttacaccttaaatttacgttacgtaagtaaaacccgtaaaagtaaaacgttacggtaaaccgtccgtacccgttaacccccgtcgtttaaccggtaacggggtttccccgggtaagggggaaacccggtaacccggtaaaaggggtttaccggaaacgtaaaacgttaaaacccgggg

SEQ ID NO: 342917 - DNA, 615 bp, Homo sapiens
  misc_feature: GZ8MTXP02JOZM2.11.70.G04.1.454.CMB.2.raw
  modified_base (228)..(228): a, c, t, g, unknown or other
  misc_feature (228)..(228): n is a, c, g, or t
tcagcgagagataccacgaccggtgctcgatttagtgtagtgtgaaggggaaagggggcagaagtctctctcagtcaggacacagcatggacatgagggtccctgctcagctcctgggactcctgctgctctggctcccagatgccagatgtgacatccagttgacccagtctccatccctccctgtctgcatctggtgggagacagagtcaccatcacttggccggngagtcgagggctagttggactaatttattacgccttaggtatcgagcaaggacgaccgaacggggtaaaccctccctaaccctccgtgacttcgtttgctgactactccgactctacgactacgtaccggacgggtcccagttcctacgtattaccgtaggtacgacgtaggtacggactacgtgggaactagtacttcacctctacacatacacgtacacgtccagacagtacctaggtaacgtagttggttactaacttaaactttagtacgtaacgaaaacgtaaaaggtacacggtcgtaccgtcccgacccgttacgtaccgttacggggttaaccgggacggtaacggggtaacgacggggtagtaacgaactaaaacggg

SEQ ID NO: 342918 - DNA, 494 bp, Homo sapiens
  misc_feature: GZ8MTXP02FR2G4.11.70.G04.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (429)..(429): a, c, t, g, unknown or other
  misc_feature (429)..(429): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatccctccctgtctgcatctgtggganacagagtcaccatcacttgccggngagtcaggcattggcaattattagctggtatcagcagagaccagggaaacctaccgtaacctcctgactctttgctgcactcactctcgcaatcgaggggtcccatctcattcagtgcagtgatgtgggacagaattcactctcacatcagcacgcctgcagccctagaagatgttagactaacttattactagtacaaaagaanagcgactcgccccgactcgtagtttccgggacggtagggacccgaagggtaggacgactaaaccg

SEQ ID NO: 342919 - DNA, 534 bp, Homo sapiens
  misc_feature: GZ8MTXP02JZUPW.11.70.G04.1.454.CMB.2.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttgccgggcagtcaggcatggcaattatttagcctggtatcagcagagaccagggaaaccctcctaacctcctgtatctttgctgcactccnctctcgactatcgacggggtcccacgtctcgacttcagttggacaggtcgacgtcttggggacaggtatttcgaactctcacatcagcacgtcngcngcctagagtactgttagactaacttattacgtagtaacaaaacgtaatagaccgtctcgtccccgtacgtaccgtacgtttccgggacgggtaaccgggacgtaaacgggtggaacggaactaaacccgg

SEQ ID NO: 342920 - DNA, 508 bp, Homo sapiens
  misc_feature: GZ8MTXP02HV0N4.11.70.G04.1.454.CMB.2.raw
  modified_base (200)..(200): a, c, t, g, unknown or other
  misc_feature (200)..(200): n is a, c, g, or t
  modified_base (344)..(344): a, c, t, g, unknown or other
  misc_feature (344)..(344): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacttggccggcagtcagggcattggcaattattagcctggtatcagcagagaccagggaaacctcctaaaccctcctgatctttgctgcatccactctcgcaatcgagggtcccatctcgattcagtgcngtgatcgtgggacagtatttcactctcacatcagcacgctgctagcctagaatagtgttgactaaagttacttactagttaacaaaaagtatagcgtacgtcgccccgcttcgaacggtttccgggacggtacgggaccgtaagggtcggaacgtacgtaaacg

SEQ ID NO: 342921 - DNA, 439 bp, Homo sapiens
  misc_feature: GZ8MTXP02FHP6M.11.70.G04.1.454.CMB.2.raw
  modified_base (433)..(439): a, c, t, g, unknown or other
  misc_feature (433)..(439): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgagtcgtcccttgaaagtaattgttagggacctccactacggtatggacgtctggggccaagggaccacggtcaccgtctcctcagcctccaccaagggcccatcggtcttccccctggccaccctcctccaagagcacctctggggcacagcggccccctgggctgcctggtcaaggtctacttccgtatctctcgctgagcgggctggcaaggcgcatagnnnnnnn

SEQ ID NO: 342922 - DNA, 582 bp, Homo sapiens
  misc_feature: GZ8MTXP02GG8MX.11.70.G04.1.454.CMB.2.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatccctcctgtctgcatcngtggganacagntcaccatcacgttggccggnagtcgaggcattggctaattattagctgtatcgagcagacgaccagggaaaccctctaacctctgattcttgctgcatccatcngcaagtcgaggtccatctcgtnttcgagtgacagtgtatcgagggactagtactttacgactctaccactactcacgactacggcccttgaccgacgtacctaggtaaagtctttaggttacgaaccgttaaagttttaacttaaccgttaagttaaaaccgaaaaaggtttactaaacggccttaccgttacggccccctaagttaccggtaacggtttccggggaacggtaacgggttaaccggaaacgggaggtaaacgaacgttaaaaccg

SEQ ID NO: 342923 - DNA, 505 bp, Homo sapiens
  misc_feature: GZ8MTXP02G3CQR.11.70.G04.1.454.CMB.2.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtggganacagagtcaccatcacgttggccgggcgagtcgagggcattggctaattattagcctggtatcagcagagaccgagggaaacctccgtaaacctcctgattctttgcttgcatccactctcgcaatcgacggggtccatctcgtattcagtgcagtgatcgnggacagtattcactctcacatcagcacgcctgcagccttagaagatgtagactaacttattactagtaactaaaagattacgacgtctacgcccgactcgtacggttcggacggtacggaccgaggtacgacgacgtaaaccg

SEQ ID NO: 342924 - DNA, 627 bp, Homo sapiens
  misc_feature: GZ8MTXP02IMYQH.11.70.G04.1.454.CMB.2.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcaccatcacgttggccgggngagtcgagggcattggacaattattagcctggtatcagcagagaccaacgggaaacctcctaacctcctagtattctttgcttgctactccactctcgacctaacgtcgtacggggtccctaattcctcgtaacttccgaaggttcgcgtagggtggtattcgtaggggactaagtactttccactctcctaacncttacagccgaacgtccctcgacgngacccgtagaaacgtagttcgttaggtaccttaaacgttatttaaccgtagttaaaaccgaaaaagtaacgtaacggtccggtaacctccgtaccccgtacgttccggttacggggtttaaccggaccggggttaaacggggaaccgtaacggggtacggaaacgtacgttaaaaccgg

SEQ ID NO: 342925 - DNA, 708 bp, Homo sapiens
  misc_feature: GZ8MTXP02HLVH8.11.70.G04.1.454.CMB.2.raw
  modified_base (201)..(201): a, c, t, g, unknown or other
  misc_feature (201)..(201): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtctccatcctccctgtctgcatctgtggganacagagtcaccatcacgttggccggcgagtcgagggcagttggctaattattagcctggtatcagcagagaccgagggtaaaccctccgtaaccctctagacttcgtttcgctgactacttcccactcctcgaccaaacgtccgaacggggtccctaacgtcgtccgtacttccgaaggtcggacgtaggtggtatccgtaggggaactaggttacttctaacccttcctacgtaaccctactccgaacgccgtaaacgtcccttggacccgtacgtaccccgtaggtaaaaccggtattacgggttacgtaaccgttaaacttttaacgtttaaaaccgtttaacggttaaaacctaaaaacgttaacgttaaacggccggtaaccccgtttacccggacccccgtaccgttaccggtaacggggtttaacccgggggaaccgggggaaacgggggtaaaccccggttaaaaggggacggtaaaccggtaaacgttaaaacccggg

SEQ ID NO: 342926 - DNA, 617 bp, Homo sapiens
  misc_feature: GZ8MTXP02H5XOB.11.70.G04.1.454.CMB.2.raw
  modified_base (198)..(198): a, c, t, g, unknown or other
  misc_feature (198)..(198): n is a, c, g, or t
  modified_base (528)..(528): a, c, t, g, unknown or other
  misc_feature (528)..(528): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttcgacccagtctccatcctcctgtctgcatctgtgganacagagtcaccatcacttggccgggcagtcgagggctagttggactaattatttagcctggtatcagcagacgaccgaagggaaaccctacctaaaccctcctagtattctttagtcttcgcactcccacgtctcgacctaatccgtacggggtccctacttctcggtacttccgaggttcggactagggtgggtactcggttagggacgtagtactttactaccttctacctacccactcagccaacgcccgtgccgtacgtccgtaggtaaacgtagttcggttatacttaaacttacttaacgtagttaaccaaaaagtacgtaacncggtacctaccgacccgtacgttacgttacgggttaaccgggacggggaaccgggtaccgtaaagggtcggttaacgaacgttaaaccg

SEQ ID NO: 342927 - DNA, 576 bp, Homo sapiens
  misc_feature: GZ8MTXP02JUYSG.11.70.G04.1.454.CMB.2.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
  modified_base (418)..(418): a, c, t, g, unknown or other
  misc_feature (418)..(418): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccatccctccctgtctgcatctggtggganacagagtcaccatcacgttcgccgggngagtcgagggcagttggacaattnttagcctggtatcagcagacgaccagggaaaccctcctaactctagattctttgctgctatccgactctcgactaagtcgacggggtccagtctcgtattcgngtgcagtgatcgtggaccngtacttcgacttcacaaccgtatcacgtcacgtcctagacncgtaccgtaggtaacgtacttacggttacggtaaccttaacgtttaacttacgtagtaaaaccgtaaaagtaacgtacggtaccgtacgtccgcccgtacgttcgttacgggttaacggacggggaacggtaccgaggtacggtaacgactaaaccgg

SEQ ID NO: 342928 - DNA, 624 bp, Homo sapiens
  misc_feature: GZ8MTXP02GX803.11.70.G04.1.454.CMB.2.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttcgaccctagtctccactcctccctgtctgctatctggtgganacagatcacatcactcggccggngagtcgaggctagtggactaattagttagtccgtggtatcgagcacgaagaccgaacgggaaacctcctaacctctgtacttcttgctcgactactccgactcgtacgactacgtacgacgggtaccagttcctcgtacttcgacggtcgcgtaggtggtatcggtacggtactagtacttacgacttccacctactaactccgagctacgcctagaccgtacgactacgggaatagttacggtacttaaacttaaacgtttaacttaacgtagtaaaactaaaaaggtactaacgggtacccgtaacgttcccgtacccggtacttaaccgggttacgggttaaccggggacggaaccgggttaacgaaggggtacgtaacggtaaacgtaaacccgg

SEQ ID NO: 342929 - DNA, 445 bp, Homo sapiens
  misc_feature: GZ8MTXP02HRGUX.11.70.G04.1.454.CMB.2.raw
  modified_base (436)..(436): a, c, t, g, unknown or other
  misc_feature (436)..(436): n is a, c, g, or t
  modified_base (438)..(445): a, c, t, g, unknown or other
  misc_feature (438)..(445): n is a, c, g, or t
tcagcgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtccttgaaagtaattgttaggacctcactacggtatggacgtcgtggggccaagggaccacggtcaccgtctcctcacgcctccaccaacggcccagtcggtccttccccctggccacccctcctccaagacgcacctcgtggggcacgagcgccccgtggctcgcctggtcaaggcctactcgtatctctcgctgacgcggctggcaagggctcgaangnnnnnnnn

SEQ ID NO: 342930 - DNA, 741 bp, Homo sapiens
  misc_feature: GZ8MTXP02JNCKW.11.70.G04.1.454.CMB.2.raw
  modified_base (202)..(202): a, c, t, g, unknown or other
  misc_feature (202)..(202): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctccagatgccagatgtgacatccagttgacccagtcctccatccctcctgtctgcatcgtggtggganacgagacgtcaccgtatccacgttggccggcgtagtccgagggctagttaggacctaagttattacgcgttaggtatcaggcaacggaacgtaccgaaacgggtaaacccttacccgtaaaccgttacctaggtaacttcgtttccggaccttggtacctaactcctaacgttctacggactaacgtccgtaaacggggtccctagttacccttcggtactttacggacggttacggacgttaacgggttacggaaacgtcccggttagggaacccttaaggtacctttaccgtacccgttacgttaccccgacctaaacggttaccacgtaccgaaaccgttccggtaaaccgtaccggtaccgtaacgtacggtaacgttacgttacggtaacgtaacgtttaacgttaacgttaacgtaaacgtaaacgtaaaacgtacgtacgtaccgtaccgtacccggtacccgtacggttaccgttacgggtaaccgggaacggtaacgggtacggtaacggtaacgtaacgtaacgtaacg

SEQ ID NO: 342931 - DNA, 676 bp, Homo sapiens
  misc_feature: GZ8MTXP02H7EBG.11.70.G04.1.454.CMB.2.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggcctcccagatgccagatgtgacatccagttcgaccctagtcctccactcctccctgtctgcntctggtgggagacagagtcaccatctacgttggccggngagtcgaggctagtggactaattatttacgcttaggtataccgagacgacgaacggaacccgaaacggggtaaaccctcccgttaaacccctccgtagtaactttcctttgccttggacctaactcccctacttccgtcgtacgaaaacgttccggaacggggttaccccctaagttcccttgtacgtttacgacggtttcggacctaggtagtacgtcgtcgggacgtacgtactttccacttacctaccacccttagaccgacgacgcgtcgtacgactagtaccgtaagtacgtagttacgtacgtaacgttaactttaacttacgtaacgtaaaacgtaaaagtacgtaacgtaccgtcccgtaccgtacccgtcgttacggtaccggttaacggggaccgggtaaacggtaccggaaggtacggtaacgtaacgtaacg

SEQ ID NO: 342932 - DNA, 662 bp, Homo sapiens
  misc_feature: GZ8MTXP02G79KN.11.70.G04.1.454.CMB.2.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacctagtcctccactccctccctgtctnctatcgtggtggganacagactccactatctacgttcgggccggcgagtcggaggtctaggttcgacttaattttacgttcgaccgttaggtactacgagacgaaggtaaccgaaccggaaacgggtaaaccccttacctaaacccgtctagtacttcgtttcgactcacctactcctactctcgactacgtccggtaccggtcctatcgtcgtactcgagtcgactggtcgtatccggtagtactacgttacttcctacctctacccgtactacaccgagaccttacgccgttcgacgtaccgtcgttaaggaaacgttgttacgtaacttaacttaaacgtttaattaaccgtagtaaaactaaaaggttacaacgtcccgtacgtcccggtacccttacgttccggttacgggtaaccgggacggggaaaccggtacggttaaggacgtaacggtacgtaaaaccgg

SEQ ID NO: 342933 - DNA, 696 bp, Homo sapiens
  misc_feature: GZ8MTXP02JG3YA.11.70.G04.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttcgacccagtctccatccctcctgtctgcattcgtggtggacgacagacgtcaccatcctacgttcggccgggngtacgtcgagggctagtggactaatttattagccttggtancgtagcaagacgaacgaagggtaaaccctacctaacctcctagtaacttcgtttacgcctcggactacgtacctacttcgtacgactaacgtacgtacggggtaccctacgttcctcgtaacgttcgacggtcgacgtacggtagtacgttacgtaggtaactacgtactttaccaacctttactaaccaaccttacgtaacgaccgacgtaaccgtcccgtacgtacccgtacgtacccgttaaggaaaacttcggttacgtacggtaacttaaacggtttacttaacgtaacggtaaaactaaaacgggtaaacctacggtaccggtactacccggtacccgacgtttaaccgtacgggttaacggaacccgggttaaagggacccgggtaaggttaacggaacgtaacgtaaaacccgg

SEQ ID NO: 342934 - DNA, 659 bp, Homo sapiens
  misc_feature: GZ8MTXP02JWTMQ.11.70.G04.1.454.CMB.2.raw
  modified_base (197)..(197): a, c, t, g, unknown or other
  misc_feature (197)..(197): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccatcctcctgtctgcatctgtggganacagagtcaccatcacttggccgggcgagtccgagggcattggactaattatttagcctggtatcagcagagaccagggtaaacctcctaactcctagacttctttgctgcactccactctcgacatcgacgggtcccattctcgtacttcgagttgacgagtggaacgttccgtagggggtaaacctagggttactttaccgtaaccgttcccgttaccaaaccccgtattaccgaaacgtccgaaacgttcccgtacgcccgttaacgacccgtaggtaaaggttaacttgggttaacgtaccgttaaaactttacgtttaaccttaggttaaaacctaaaaggtaacgttaacggaccgtaccgttacccggtccccgtacgttacccggttacggtttaaccggggacggttaaccggggaacgtaacggggttacggaacggttactaaaacccggg

SEQ ID NO: 342935 - DNA, 500 bp, Homo sapiens
  misc_feature: GZ8MTXP02IDLTM.11.70.G04.1.454.CMB.2.raw
  modified_base (481)..(481): a, c, t, g, unknown or other
  misc_feature (481)..(481): n is a, c, g, or t
  modified_base (483)..(500): a, c, t, g, unknown or other
  misc_feature (483)..(500): n is a, c, g, or t
tcagcgagagataccacgaccggtgctcgatttagtgtagtgtgaagggaaagggactggagtggattggtcatatcgataccactggaaacaccaattacaaccccctccctcaagagtcgagtcaccatatccctgacgtccaagagtcagctctccctggagctgacttctgtgaccgccgcagacacggccgtgtattactgtgcgcgacgtcgtcctagaaagtattgtacggacctcactacggtatggacgtcgtggggaccgaagggaccgacggtcacccgtctacctcacgccctacccacgaacggcccacgtccggtcccttcccccgtggccctacccctcctccaaaggcgcccaccgtcggtcggggaccacgacggccggcccccgtgggcctcgccgttggaccaaggtcctacgtttcgacttccgtctcgctcggcgtcgggcgtggacgacggcagtacgngnnnnnnnnnnnnnnnnnn

SEQ ID NO: 342936 - DNA, 530 bp, Homo sapiens
  misc_feature: GZ8MTXP02FPBT9.11.70.G04.1.454.CMB.2.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctccagatgccagatgtgacatccagttgacccagtctccactcctccctgtctgcatctgtgganacagagtcaccatcacttgccggcgagtcaggcattggcaattattagcctggtatcagcagagaccagggaaacctccaacctcctgatctttagacttgcatccactcncgctaatcacggggtcccatctcgattcagtgcaagtgatcgtgggactagtattcactctcacatcagcagcacncacnctacgagatagtagtactaacttacttacgtacgtaacgtaaaacgaaagttagacgtacgttacgaccccgtaccgtacgtacggttccggttacgggaacgggaaccggtaaccggttaggacggtacgtaaaacccgg

SEQ ID NO: 342937 - DNA, 678 bp, Homo sapiens
  misc_feature: GZ8MTXP02FJVOY.11.70.G04.1.454.CMB.2.raw
  modified_base (238)..(238): a, c, t, g, unknown or other
  misc_feature (238)..(238): n is a, c, g, or t
tcagcgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttcgacccagtcctccactccctccctgtctgctatcgtggtggagacagacgtccacctatccacgttcggccgggngacgtcgagggctagttgactaattagttagcgtggtatcgagacgagacgaaccgaacgggtaaaccctacctaaccctccgtagtacttcttgctcgtctactcctactcgtcgacctaacgccggtaccgggtaccctagttccgtcgtacgttacgtaggtcggcgtaggtggtacgttcggtagggtaactagttacttacctaccttaccacctacctaacgtcgacgcgacgtccgtacgccgacgtccgtaagtaagtacgttcgttacgttaacttaaaacgttacgttaaccgtaagtaaaacgtaaaacgtacgtacggtacccgtaacccgtaccggtccccgtaccgttacggtttaccggggttaacgggaacccgggggtaaacggaccgggtaagggtacggaaacgtaaacggtaaaacccgg

SEQ ID NO: 342938 - DNA, 529 bp, Homo sapiens
  misc_feature: GZ8MTXP02JO90U.11.70.G04.1.454.CMB.2.raw
  modified_base (198)..(198): a, c, t, g, unknown or other
  misc_feature (198)..(198): n is a, c, g, or t
  modified_base (385)..(385): a, c, t, g, unknown or other
  misc_feature (385)..(385): n is a, c, g, or t
tcagcgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctcctgtctgcatctgtggganacagagtcaccatcacttgccgggcgagtcagggcattggcaattattagcctggtatcagcagagaccagggaaacctcctaacctcctgatctttgctgcatccactctcgcaatcaggggtcccatctcgattcagtgcagtggatcgtggacagtcttcactctcaccatcagcagcctagcngacctgaagtatgttagactaacttattacgtagtacctaaaagtaagttacgacgtactaccggccccgtaaccgttcgtaaacggttttccgggacgggaacggggtaacccgtaagggttacggaacggtactaaaaccgg

SEQ ID NO: 342939 - DNA, 589 bp, Homo sapiens
  misc_feature: GZ8MTXP01BO1R5.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccacggcccccggacaaagccttgagtggatgggatcgatcaactctggcaagtggacaaacaacaaaatacttacaacagaacgttacgaagggacaaggactaccgaaacctattaacccgaggggaacaacactacccgacgaacacaacgaccctaacagtggagcagacgacgacgccgtagacattacgagaacgacgacggctgtgtattactggttaacggagacgggtcttacggtcgtgggttagttcgttagttaagttaggttgtacgttcggttcggttccgttcgggggtaacccg

SEQ ID NO: 342940 - DNA, 534 bp, Homo sapiens
  misc_feature: GZ8MTXP01C00Z0.4.58.F03.1.454.CMB.2.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (470)..(470): a, c, t, g, unknown or other
  misc_feature (470)..(470): n is a, c, g, or t
  modified_base (524)..(524): a, c, t, g, unknown or other
  misc_feature (524)..(524): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctgggctgaggtgaagaagcctggggcctcagtgagggtttcctgcaaggcttctggatacaccttcagtagttatactatacactgggngcgccaggcccccganaaagccttgagtggatgggatcgatcaactctggcaatggacaaacacaaaatacttacacagaaagttacaagggacaagagtcaaccattacccgagggacacatccgacgaacacagaccctacagtggagctgagcacgcctgacatctagaagcgacggctgtgtattactgtcgngacgggtcttagtcgtgggttattcgttagttaatagtgacttcgttcgttcgnggggtaaccg

SEQ ID NO: 342941 - DNA, 534 bp, Homo sapiens
  misc_feature: GZ8MTXP01DFCQ7.4.58.F03.1.454.CMB.2.raw
  modified_base (289)..(289): a, c, t, g, unknown or other
  misc_feature (289)..(289): n is a, c, g, or t
  modified_base (413)..(413): a, c, t, g, unknown or other
  misc_feature (413)..(413): n is a, c, g, or t
  modified_base (496)..(496): a, c, t, g, unknown or other
  misc_feature (496)..(496): n is a, c, g, or t
tcagagcactgtagcacgaccggtgctcgatttagtctgatcgagaagggaaggggacccaacaaccacatccctcctcagaagccccagagcacaacgcctcaccatggactggacctggaggatcctcttttggtggcagcagccacaggtgcccattcccaggtccagcttgtgcagtctgggctgaggtgaagaagcctggggcctcagtgagggtttcctgcaaggcttctggatacaccttcagttagttatactatacactgggtgcgccaggcccccgganaaagccttgagtggatgggatcgatcaactctggcaatggacaaacacaaaatacttacaacagaagttacaagggacaagagtcaccattaccagggacacatccgacgaacacagccctaanatggagctgagacagcctagacatctagaagacacgggtactgtgtattactggttcgagacgggtcttagtcgtgggacttnttagttaatagtgtactcggttcgttcgttggggtccg

SEQ ID NO: 342942 - DNA, 561 bp, Homo sapiens
  misc_feature: GZ8MTXP01C9OS7.4.58.F03.1.454.CMB.2.raw
  modified_base (291)..(291): a, c, t, g, unknown or other
  misc_feature (291)..(291): n is a, c, g, or t
  modified_base (447)..(447): a, c, t, g, unknown or other
  misc_feature (447)..(447): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctgggctgaggtgaagaagcctggggcctcagtgagggtttcctgcaaggcttctggatacaccttcagttagttatactatacactggtgcgccacggcccccganaaagccttgagtggatgggatcgatcaactcgtggacaagtggacaaacacaaaatacttacacagaaagttacaagggacaagagtcaaccatacccgagggacacatccgacgaacacagaccaacatggagctagagacagctagacattacngaaacgacacggtactgtgtattacgtgttcgaaggcgggtcttaggttcgtggggttacttcgttagtttaataagttcgtacgttcggttcgttcggttcggggtaacccgg

SEQ ID NO: 342943 - DNA, 601 bp, Homo sapiens
  misc_feature: GZ8MTXP01BP6NO.4.58.F03.1.454.CMB.2.raw
  modified_base (299)..(299): a, c, t, g, unknown or other
  misc_feature (299)..(299): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctggaggtgaagaagcctggggcctcgagtgagggtttcctgcaaggcttcgtggatacaccttcagttagttatactatacactgggtgcgccacgggcccccgganaaagccttgagtggagtgggatcgatcaactctggcaagtcggacaaacaactaaaaatacttacaacgaagtaaagttacgaaggggacaaggacgtacaaccaattaccgaagggacacatccgacaaacacaagccctaacagtggagctagagacacggcctaggaacctatacgtagaacgaccgaggtactgttagtacttacgtggttaacgaggttacgggtccttaggtccgtagggttacttcgttagttaattagtcgtaccgttcggttcgttcggttcggggtaacccg

SEQ ID NO: 342944 - DNA, 535 bp, Homo sapiens
  misc_feature: GZ8MTXP01DU4UF.4.58.F03.1.454.CMB.2.raw
  modified_base (293)..(293): a, c, t, g, unknown or other
  misc_feature (293)..(293): n is a, c, g, or t
  modified_base (504)..(504): a, c, t, g, unknown or other
  misc_feature (504)..(504): n is a, c, g, or t
tcagagcactgtagcacgaccggtgctcgatttagtctgatcgagaagggaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccacggcccccgganaaagccttgagtggatgggatcgatcaactctggcaatggacaacacaaaatacttacaacagaagttacaaaggggcaagagtccaacctataccgagggacacatccgacgaacacagcctacatggagctagagacagcctgacatcgtagaagcacggctgtgttattactgtaacgaggcggtcttagtcgtgggattcttagttntagtgtactcggttcgttcgcggggtaaccg

SEQ ID NO: 342945 - DNA, 589 bp, Homo sapiens
  misc_feature: GZ8MTXP01EZ6RH.4.58.F03.1.454.CMB.2.raw
  modified_base (229)..(229): a, c, t, g, unknown or other
  misc_feature (229)..(229): n is a, c, g, or t
  modified_base (294)..(294): a, c, t, g, unknown or other
  misc_feature (294)..(294): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttccngcaaggcttctggatacaccttcagtagttatactatacactgggtgcgccgacggcccccgganaaagccttgagtggatgggatcgatcaactctggcaagtggacaaacaacaaaattacttacaacaagaaagttaccaaaggggacaaggacgtacaaacctattaacccgaaggggaccaacactaccgacgaaacacacgcctaacatggagcngagacagccgtanactactacgagaacgacgacggtcttgtagttattacgtggttaacgaggttacgggcttaggtcgtagggttacttcgttaagttaatagttcgtacgttcggttcggttcggttcgggtaaccg

SEQ ID NO: 342946 - DNA, 529 bp, Homo sapiens
  misc_feature: GZ8MTXP01BTXHE.4.58.F03.1.454.CMB.2.raw
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccgganaaagccttgagtggatgggatcgatcaactctggcaatggcaaacacaaaatacttcacagaaagttacaagggcaagagtcaccattaccagggacacatccgcgaacacagcctacatggagctgagcagcctgacatctgaacgcacggcttggtgtattacgtgttcgaggcgggcttagtcgtgggattcttagttaataggtgtactcgttcgttgttcgggggtaacccg

SEQ ID NO: 342947 - DNA, 514 bp, Homo sapiens
  misc_feature: GZ8MTXP01EJARW.4.58.F03.1.454.CMB.2.raw
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgntcaactctggcaagtggcaaacncaaaatacttacacagaagttacaagggcaagagtcacatacagggcacatccgcgaacacagcacatcgagcngagcagcctgacntcngaagcacgctgtgtattactgttcgagacgggcttagtctggggattnagtttaanagtgactcgttcgttcgttggggaacccgg

SEQ ID NO: 342948 - DNA, 583 bp, Homo sapiens
  misc_feature: GZ8MTXP01EDGAN.4.58.F03.1.454.CMB.2.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagagcactgtagcacgaccggtgctcgatttagtctgatcgagaagggaaagggacccaacaaccacatccctcctcagaagccccagagcacaacgcctcaccatggactggacctggaggatccttctttttggtggcagcagccacaggtgcccattcccaggtccagcttgtgcagtctggggctgaggtgaagaagcctggggcctnagtgagggtttccngcaaggcttntggatacaccttcagttagttatactatacactgggtgcgccacggcccccgganaaacgtccttgagtggatgggatcgatcaactctaggcagtggacaaacacaaaatacttacaanagaagttacaagggacaagacgtcaccattaccgagggacacactccgacgaacacacgacctaacgagtaggacgtcagacgacgacgccgtagaactattcgagaaacgcgaacggtctgttagttaacttccgtggttaacgaaggttacggggtacttaggtcgtagggttacttcgttagttaatgtcgtacgttcgttcggttcgttcgggtaacccgg

SEQ ID NO: 342949 - DNA, 525 bp, Homo sapiens
  misc_feature: GZ8MTXP01EHY8W.4.58.F03.1.454.CMB.2.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
tcagagcactgtagcacgaccggtgctcgatttagtctgatcgagaagggaaaggggaaccaacaaccacatccctcctcagaagcccccagagcacaacgcctcaccatggactggacctggaggatcctctttttggtggcagcagccacaggtgcccattcccaggtccagcttgtgcagtctgggctgaggtgaagagctgggcctnagtgaggtttcngcaaggcttctggatacaccttcagtagttatactatacactgggtncgccaggcccccganaaagccttgagtggatgggatcgatcaactctggcaatggacaacacaaaatcttacanagaagttacaagggcngagtcaccattaccgagggacacatccgacgaacacagcctaacatggagctgagcagctgactatctagaagacacggcttggtgttattactggttcgaggacgggcttagtcgtgggattcttaggttaatagtgactcggttcgttcgttggggtaacccg

SEQ ID NO: 342950 - DNA, 654 bp, Homo sapiens
  misc_feature: GZ8MTXP01CPI9L.4.58.F03.1.454.CMB.2.raw
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (441)..(441): a, c, t, g, unknown or other
  misc_feature (441)..(441): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctggggcctcagtgaggtttcctgcaaggcttctggatacaccttcagttagttatactatacactgggncgccacggccccccggaanaaacgccttgagtggatgggatcgatcaactcgtggcaagtggacaaacaaataaaatacttacacaagtaagttacgaagggcaagagtccaacctataccgagggacacactccgacgaacacacgaccctaacagtagggacncgtagacgcgacgccgtagaacctataccgtaagaaacgaccgtaacggtccttaggtacgttaacttttaccggttggtttaaccggaacgggttaccggggttaccgttaaagggtttccggtagggggttactttacgtttaaggtttaagtaacgggtttcggtaaccggtttcgggttccggtttcccgggttcgggggtaaccccgg

SEQ ID NO: 342951 - DNA, 614 bp, Homo sapiens
  misc_feature: GZ8MTXP01BJCBB.4.58.F03.1.454.CMB.2.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagctgggctnagtgagggtttccngcaaggcttctggatacaccttcagttagttatactatacactgggtncgccaggcccccganaaagccttgagtggatgggatcgatcaactctggacaagtggacaaacaacaaaattacttacaacaagtaaagttaccgaaagggacaaggacgtaccaaacctattaacccgaaggggaccaacactaccgacgaacaacacgacctaacgagtggacgtccaggacgacgacgacccgtagaaccctataccgtagaaacgaccgacgggtccttaggttagttaattaacgtggtttaacggagttacggggtcttaggtccgtaggggttacttcgttagtttaatagtcgtacgtcgttcgttcggttcgggtaacccgg

SEQ ID NO: 342952 - DNA, 650 bp, Homo sapiens
  misc_feature: GZ8MTXP01ETFQX.4.58.F03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
tcagagcactgtagcacgaccggtgctcgatttagtctgatcgagaagggaaagggacccaacaaccacatccctcctcagaacgcccccagagcacaacgcctcaccatggactggacctggaggatccttctttttggtggcagcagccacaggtgcccattcccaggtccagcttgtgcagtctggggctggaggtgaagaagccgtggggcctnaggtgtagggtttccngcaaggtcttcgtggatactaccttcagttagttatactatacactgggngcgccacggcccccggaanaaagccttgagtggagtggatcgatacaactcgnggacaagtgacaaanaaactaaaatactacaactaagtaaacgttacgaaagggacaaggtacgtacaaacctaacgttaaccgaagggacctaacgactaccgaacgaaacaacgaacgaccctaacgagtaggacgacgtagacgacaacgtccggtaacgaactacgtacgaaggaacgaccgacggtacgttgtagtttacttaccgttggttaacggtaacgggttacgggtacgttacggtcgtagggttacttcgttaagttaagtaggtcgtacgttcggttcgttcggttaacggggtaaccgg

SEQ ID NO: 342953 - DNA, 678 bp, Homo sapiens
  misc_feature: GZ8MTXP01BV7OZ.4.58.F03.1.454.CMB.2.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctgggctgaggtgaagagcctgggcctnagtgagggtttccngcaaggcttnggatacacttcagtagttatactatacactgggtncgccaggcccccganaaagccttgagtggatgggatcgatcaactctggcaagtggacaaacaacaaaatacttacaacaagaaagttacgaaaggggaccaaggacgtaccaaaccctaagtttaacccgaaggggaccaacactacccgacggaaacacaacggaccctaaaccgagtacgggaacgccgtagaacgcacggacccttaggaacctataccgtaggaaacgacgacgggtacttggttacgttaactttacgttggtttaacggaacgggttaccggggtaccttaaggttccggttgggggttaaactttccggtttaaaggtttaacgtttaagggttaacgtaaccggtttccggtttacccgggttttccggtttcggggggtaaccccgg

SEQ ID NO: 342954 - DNA, 647 bp, Homo sapiens
  misc_feature: GZ8MTXP01DLIYD.4.58.F03.1.454.CMB.2.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (610)..(610): a, c, t, g, unknown or other
  misc_feature (610)..(610): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctggaggtgaaggaagccgtggggcctcagtgtagggtttcctgcaaggcttcgtggatacctaccttcagttagttatactatacacgtgggcncgccgacggcccccgaanaaacgtccttgagtggagtgggatcgaatcaactcgtggacaagtggacaaacaacaaaattactacaacaagtaaacgttaaccgaaggggtacaaggacgtaccaaaccctaacgttaaccccgaaggggaaccaaccgtaacgtacccgaaccgaaaccaaccaacgaccctaaacctagtacgggacgacaggacgcaacggtccctaggaacctactacgagaaacgacgacggtcttagtgttattacgtggttaacgacggttacgggtacttaggtcgtgggttacttgttaaagttntaggttcacgttcgttcggtttcgcgggggtaacccg

SEQ ID NO: 342955 - DNA, 577 bp, Homo sapiens
  misc_feature: GZ8MTXP01C35AG.4.58.F03.1.454.CMB.2.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (349)..(349): a, c, t, g, unknown or other
  misc_feature (349)..(349): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctggggcctnagtgaggttccngcaggctnggatacncttcagtagttatactatacactgggtgcgccacggcccccgganaaagccttgagtggatgggatcgatcaactctggcaatggacaaacacaaaatacttacanaagaagttacaagggacaagagtcaaccattaccaggggacacatccgacgaacacagctacatgagcagagcaagcctagaacatacctagaaacgacgacggacgtgtagttaattaccgttgtttaaccggaggaccgggtcgttaagttccggtaggggttattcgttaaggtttaagtaaggttgtaccgttcggttcggttaacgttgggggtaaccccggg

SEQ ID NO: 342956 - DNA, 608 bp, Homo sapiens
  misc_feature: GZ8MTXP01EQDPR.4.58.F03.1.454.CMB.2.raw
  modified_base (141)..(141): a, c, t, g, unknown or other
  misc_feature (141)..(141): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatcctctttttggnggcagcagccacaggtgcccattcccaggtccagcttgtgcagtcgtgggctgaggtgaagagcctgggcctnagtgagggtttccngacgagtctgagatactacttnagttatatactatacacgtggcgcgccgaccggaccccgaanaacgctagagtggagtggatacgatacactcgtagacaagtgaacaaacaaactaaatactacaanaagtaacgtacgaagggacaagtactaccaacctacgtaaccgaggacacgacgtaccgaacaacacaacgacctaanagtaggacgacgtagacgacacgacgtacgactacgtacgagaacgacgacgtagttagtagttacttcgtacggtaacggtacggttacggtacgttacggtacgtaggttagtttcgttaagtttaagtacgtaacgtaccgttcggttacggttcggttccgggaaccg

SEQ ID NO: 342957 - DNA, 554 bp, Homo sapiens
  misc_feature: GZ8MTXP01CI367.4.58.F03.1.454.CMB.2.raw
  modified_base (294)..(294): a, c, t, g, unknown or other
  misc_feature (294)..(294): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccacggcccccgganaaagccttgagtggatgggatcgatcaactctgggcaatggacaaacaacaaaatacttacacagaagttacaagggcaagagtacaccataccagggacacactcgacaacacagctanatgganctgagcaggcctgactatctagaacgacgacggctgtgttattacgtgttaacggaggacgggtcttaggtcgtgggacttcgttaagtttaataggtcgtacgttcggttcgtttcggttggggtaaccccgg

SEQ ID NO: 342958 - DNA, 568 bp, Homo sapiens
  misc_feature: GZ8MTXP01D0WC2.4.58.F03.1.454.CMB.2.raw
  modified_base (215)..(215): a, c, t, g, unknown or other
  misc_feature (215)..(215): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtgggctgaggtgaagaagcctgggcctnagtgaggtttcctgcaaggcttctggatacaccttcagttagttatactatacactgggngcgccacggcccccganaaacgccttgagtggatgggatcgatcaactctggacaagtggacaacaacaaaatcttacaacagtaagttacgaagggacaagacgtacaccattaccgagggacacactccgacgaacacagacctacgataggagctgagcacgcctagactatcgagaacgacgacgtctagtgttattacgtggttaacgaggacgggtcttagtcgtgggttacttcgttaagtttaataggttcgtacgttcggttacgttcggttcggggaacccgg

SEQ ID NO: 342959 - DNA, 607 bp, Homo sapiens
  misc_feature: GZ8MTXP01A2EWE.4.58.F03.1.454.CMB.2.raw
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctgggctgaggtgaagagccgtgggcctcagtgagggtttcctgcaaggcttctggatacaccttcagttagttatactatacactgggtncgccacggcccccganaaagcctgagtgagtggatcgatcaactctggcaagtggacaacacaaaatactacaacagaaagttacgaagggcaagagtacaacctattaaccgagggaacacactaccgacgaacacgagccctaacgatggagctgacgcacgccgtaggaactactcgtaagaaacgaccgaacggtccgttaggttacgttaagtttccgtagggtttccggaacggttacggggtaccttagggttaccgtgggggttacttcgttaggttaagtaggtgtacgttcggttcgggttccggttcgggggtaaccccgg

SEQ ID NO: 342960 - DNA, 607 bp, Homo sapiens
  misc_feature: GZ8MTXP01D8VB1.4.58.F03.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtgggctgaggtgaagagccgtgggcctcagtgaggtttccngcaaggcttcngatacacttcagttagttatactatacacgtgggngccgccgacggccccccggaanaaacgtccttaggagtggagtggatcgatcaactctggacaagtggacaaacgaacaaaattactacaataagtaaacgttacgaaagggacaaggacgtaccaacctaataaccgagggacacactaccgacgaacacacgacctaacgagtggaacgcgagacgacacgcctagactactacgagaacgacgacggtcttggtagttaattccgtggttaacgacggttacgggtacttaggttcgtagggttattcttaagggttaatggtaacgtacgttcggttcgttcgggttcgggtaacccg

SEQ ID NO: 342961 - DNA, 543 bp, Homo sapiens
  misc_feature: GZ8MTXP01DK838.4.58.F03.1.454.CMB.2.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagcctggggcctnagtgaggtttccngcaaggcttctgatacaccttnagtagttatactatacactggngcgccacggcccccganaaagccttgagtggatgggatcgatcaactctggcaatggacaaanacaaaattactacanagaagttacaagggcaagagtcaacataccagggacacatcgacgaacacagctaacataggagctgagcaagccgtgaactagtccaggaacgacacgggtctgtgtattacgtgttaacgaggacggcttagtcgtgggattcgttagttaagtagtcgtacctcggttcgttcggttcggggtaacccgg

SEQ ID NO: 342962 - DNA, 532 bp, Homo sapiens
  misc_feature: GZ8MTXP01CLKB4.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacacttcagtagttatactatacactgggtgcgccacggccccccggacaaagccttgagtggatgggatcgatcaactctggcaatggacaaacacaaaatacttacacaagaagttacgaagggcaagagtcacataccagggacacactcgacgaacacacgactacatggagctagagcacgctgacatcagaaagacacggactgtgtattacgtgtcgagacgggtcttagtcgtgggattcttagttaatagtgacgtcgttcgttcgttcggggaaccgg

SEQ ID NO: 342963 - DNA, 712 bp, Homo sapiens
  misc_feature: GZ8MTXP01DTFX8.4.58.F03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtcgcccattcccaggtccagcttgtgcagtcgtgggctggaggtgaagagccgtgggcctnagtgtaggtttcngcaggcttngatacacttnagttattatactatacactgggcncgccacggcccccggaanaaacggccttgagtggatgggatcgatcaactcgtggacaagtcggactaaacaactaaaattacttacaacgtaagtaaacgttacgaaaggggactaaggaacgttaccaaacccgtaactttaaaccccggaaggggaaacccaacgtaacgttacccggaaccggaaaccaacaacggacccttaaacgacgttaggacggacaggaacgacgacggacccgttagaactacgtacctaggaaaccgacgaacggtacgttaggttacgttaattaccggttggttaacggaacgggttaccgggggtacctttaaagggtccggttaaggggttactttcggtttaacgggtttaagttaacggttcggttaaccgttcgggtttccgggtttccggttcgggggtaaccccggg

SEQ ID NO: 342964 - DNA, 593 bp, Homo sapiens
  misc_feature: GZ8MTXP01CAI24.4.58.F03.1.454.CMB.2.raw
  modified_base (229)..(229): a, c, t, g, unknown or other
  misc_feature (229)..(229): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (555)..(555): a, c, t, g, unknown or other
  misc_feature (555)..(555): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttccngcaaggcttcgtggatacacttcagttagttatactatacactgggngcgccgacggcccccganaaacgccttgagtggatgggatcgatcaactctggcaagtggacaaacaacaaaattacttacaacagaaagttacgaagggacaaggagtaccaacctagttacccgagggtaccacactacccgacgaacacgacgaccctaacgagtgggacgcgtagagacgacgccgtagacctagtcgtagaacgaccgacggtcgtgttagttattacgtggttaacggagttcgggtcttaggtcgtggttacttcgttagtntagtcgtacgttcggttcgttcggttcggggtaacccg

SEQ ID NO: 342965 - DNA, 543 bp, Homo sapiens
  misc_feature: GZ8MTXP01AOCPO.4.58.F03.1.454.CMB.2.raw
  modified_base (213)..(213): a, c, t, g, unknown or other
  misc_feature (213)..(213): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctnagtgaggtttcctgcaaggcttctggatacaccttcagtagttatactatacactgggtncgccacggcccccganaaacgccttgagtggatgggatcgatcaactcgtggcaagtggacaaacacaaaatacttacaacagaaacgttacgaagggacaaggacgtcaacctaattacccgaggggacacactccgacgaacacagcctacatggancgtgagcagcgtgacatctagagacacggctgtgtattcgtgttcgaggcgggtnttaggtctgggattcgttaggttntagtgtactggttcggttcgnggggtaacccg

SEQ ID NO: 342966 - DNA, 572 bp, Homo sapiens
  misc_feature: GZ8MTXP01EQLY0.4.58.F03.1.454.CMB.2.raw
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (452)..(452): a, c, t, g, unknown or other
  misc_feature (452)..(452): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagaagccgtgggcctcagtgagggtttccngcaaggcttctggatacaccttnagttagttatactatacactgggngcgccacggcccccganaaagccttgagtggatggatcgatcaactctggacaagtggacaaacaacaaaaatacttacaacaagaaagttacgaaagggcaaggagtaccaacctaagttaaccgaaggggacaacacgtcccgacgaaacacaacgacctaacagtggagcngagcagcctgaacatcgagaagcacggctgtagttattactggttcgaagttcgggcttagtcgtgggacttgttagttaatagtgtacgttcggttacggttcgttcgggggtaacccg

SEQ ID NO: 342967 - DNA, 600 bp, Homo sapiens
  misc_feature: GZ8MTXP01D5M0L.4.58.F03.1.454.CMB.2.raw
  modified_base (243)..(243): a, c, t, g, unknown or other
  misc_feature (243)..(243): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctggaggtgaagaagccgtgggcctcagtgtagggtttcctgcaaggtcttnggatacacttcagttattatactatacactgggtgccgcccgacgggcccccgaacgaaacgtccttaggaggtggagtgggatcgatcgaactcgtaggacaagtggacaaacaaactaaaactacttacaaacaagtaaacgttacgaaagggacaaggtacgtaccaaccagttaacccgaagggactacactccgacgaacacgacgacctaacagtacgacgacgtgacgacacgctacgactatacgtagaacgacgacggtctgtagtattacgtgtaacggaggacggtcttaggtcgtggcgttgttagttaagtacgtgtacgtcgttcgttcggttcggtaaccgg

SEQ ID NO: 342968 - DNA, 643 bp, Homo sapiens
  misc_feature: GZ8MTXP01BFAJM.4.58.F03.1.454.CMB.2.raw
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagagccgtgggcctgagtgtaggtttcctgcaaggtcttcgtggatacaccttnagttagttatactatacagtgggngcgccgacggcccccganaaagccttgagtggagtggatcgatacgaacttcgtggactaagtggacaaaacaactaaaaattaccttaccaaacgtaaggtaaacgtttaaccgaaggggaacctaaggaacgttacccaaacccttaaagttaacccgaacggggaaacaacgtacgtacccgacgaaacacaagtaccctaacgaagttcggacgaccttagaacgaccgacgcccgtaggactaacgttacgagaaacgtaccgacgtcgtgtagttacttacgtggttaacgtaaggacgggtcttaggtgtgggattcgttaagttaatagtgtacgtggttcgtcgttgggaacccg

SEQ ID NO: 342969 - DNA, 615 bp, Homo sapiens
  misc_feature: GZ8MTXP01CG8WR.4.58.F03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatccttctttttggtggcagcagccacaggtcgcccattcccaggtccagcttgtgcagtcgtggggctgaggtgaagaagcctggggcctnagtgtagggtttccngcaaggtcttcgtggatacaccttcagttagttatactatacactgggngcgccacggcccccganaaacgccttgagtggagtggatcgatcaactcgtggcaagtggacaaacaacaaaatactacacaagtaagttacgaaagggacaagagtacaacctataccgagggacacactccgacgaacacacgacctaacagtagagcgtagaacgcgacgccgtaggaactacgtacgtaacggaaacgaccgtacggtcgttagttacggtttaactttacgttggtttaacggaagggttacgggtcttaggtcgtgggttacgttgttagttaagtacgttgtacgttcggttcggttcggttcggggtaacccgg

SEQ ID NO: 342970 - DNA, 637 bp, Homo sapiens
  misc_feature: GZ8MTXP01DDGVN.4.58.F03.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
tcagagcactgtagcacgaccggtgctcgatttagtctgatcgagaagggaaggggacccaacaaccacatccctcctcagaacgcccccagagcacaacgcctcaccatggactggacctggaggatccttctttttggtggcagcagccacaggtgcccattcccaggtccagcttgtgcagtcgtggggctgaggtgaagaagccgtggggcctgagtgtagggtttcctgcaaggtcttctggactacaccttcagttagttatactatacacgtgggcgcgcccgacgggaccccccgaanaaacgtccgttagaggtggagtgggatcgatcaactcgtggacaagtggaacaaacaanaaaattctacaanaagtaagttacgaaagggacaaggacgtaccaaacctagttaacccgaagggacaacactaccgacgaaacacacgacctaacagtggagtcagagacgaacgccgtagaactatacgagaaacgacgacggtcttaggttacgttactttacgtcggttaacggaagggttacgggtacgttaggtcgtagggttatttcggttaagtttaacgtaagttcgtaccgttcggttaccggtttcggcgggggtaacccg

SEQ ID NO: 342971 - DNA, 615 bp, Homo sapiens
  misc_feature: GZ8MTXP01AK3TL.4.58.F03.1.454.CMB.2.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtcgcccattcccaggtccagcttgtgcagtcgtggggctggaggtgaagagccgtggggcctgagtgtaggtttccngcaggtcttgngatacacttnagttagttatactatacagtggngcgccgacggccccgaanaaacgtccttaggagtggagtggatcgatacaactcgtaggcaagtgacaaacaaactaaattactacaactaaggtaaacgttacgaagggcaaggtacgtaccaacgtacgtaccgaggacacacgtaccgacgaacacgacgacctaacgagtaggacgtcgagacgacgacggcctaggactacgtacgtagaaccgacgtacggtagttgttagttacgttacgtggttaacggacggttcggggtacttggtacggtaggttagttcgttagttgtacgtcgtacgttcgttcggtcggttcggggtaacccgg

SEQ ID NO: 342972 - DNA, 622 bp, Homo sapiens
  misc_feature: GZ8MTXP01DFX52.4.58.F03.1.454.CMB.2.raw
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaggggacccaacaaccacatccctcctcagaagcccccagagcacaacgcctcaccatggactggacctggaggatcctctttttggtggcagcagccacaggtgcccattcccaggtccagcttgtgcagtctgggctgaggtgaagaagccgtggggcctcagtgagggtttcctgcaaggcttctggatacaccttcagtagttatactatacactgggngcgccgacggcccccganaaacgccttgagtggatgggatcgatcaactcgtggcaagtggacaaacaacaaaattacttacaacagtaaagttacgaaggggacaaggagtaccaaaccattaacccgaggggacacactacccgacgaaacacaacgaccctaacagtaggagctagacgacacgccgtagactatacctagaaacgacgacgggtactgttgttaattacgtggttaacgaacggacgggtacttaggttccgtggggttaactttcgttaaggtttaagttaggttaacggtaccgtttccgggttccggtttccggttcgggggtaaccccgg

SEQ ID NO: 342973 - DNA, 606 bp, Homo sapiens
  misc_feature: GZ8MTXP01AE7CZ.4.58.F03.1.454.CMB.2.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagccgtgggcctnagtgaggtttccngcaggcttngatacaccttnagttagttatactatacactgggtgcgccacgggccccccgaanaaacgccttgagtggatgggatcgatcaactntggcaatggacaaacacaaaattcttacacaagtaagttacgaagggacngagtcacattaccgagggacacactccgacgaacacacgacctacatggaanctagagcacggcctaggactactacctagaaacgaccacggtcttaggtcgttaagtttacgtggtttcggaacggttacggggtcttaacggttccggtaaggggttattccggttagtttaagttaggtaacgttaaccgttcgggttaccggtttcgggttcgggggttaaccccggg

SEQ ID NO: 342974 - DNA, 596 bp, Homo sapiens
  misc_feature: GZ8MTXP01AEQAP.4.58.F03.1.454.CMB.2.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatcctctttttggtggcagcagccacaggtgcccattcccaggtccagcttgtgcagtctggggctggaggtgaagaacgccgtggggcctcagtgagggtttccngcaaggcttctggatacaccttcagttagttatactatacactgggngcgccacggccccganaaacgccttgagtggagtggatcgatacaactctggacaagtggacaaacaacaaaatcttacacaagaagttacgaaagggcaagtacgtaccaacctattaccgagggacacgactaccgacgaacacacgaccctaacagtaggacgctaggagacacggccctagaactacgtaccgtaagaacgaccgacgggtacttgtagttacttacgtggttaacggaggttacgggtcttaggtcgtagggttacttcgttagttaatgtcgtacgtcggttcgttcgttcggggtaacccg

SEQ ID NO: 342975 - DNA, 616 bp, Homo sapiens
  misc_feature: GZ8MTXP01E4NR0.4.58.F03.1.454.CMB.2.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (457)..(457): a, c, t, g, unknown or other
  misc_feature (457)..(457): n is a, c, g, or t
tcagagcactgtagcacgaccggtgctcgattttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctggggcctcagtgagggtttccngcaaggcttcnggatacaccttnagtagttatactatacactgggtgcgccacggcccccggacaaagccttgagtggagtgggatcgatcaactcgtggacaagtggacaaacaaacaaaattacttacacaagtaaacgttacgaaagggcaaggtacgtacaaccctaattaaccgaaggggaacacactacccgacgaaacacacgctacaagtggagtcgngagcacgctagacatacagaacgacgacgggctgtgttaattacgtggtttaaccgaaggttacgggtcgttaaagtccggttaggggaactttcgttaaggtttaagtaagttcgtaaccgttcggttacgtttaaccggttcgggggtaaccccggg

SEQ ID NO: 342976 - DNA, 615 bp, Homo sapiens
  misc_feature: GZ8MTXP01ETO9R.4.58.F03.1.454.CMB.2.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (567)..(567): a, c, t, g, unknown or other
  misc_feature (567)..(567): n is a, c, g, or t
tcagagcactgtagcacgaccggtgctcgatttagtctgatcgaggaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctgggcctcgagtgagggtttccngcaaggtcttcgnggatacaccttcagtagtatactatacactgggncgccgaggcccccgaanaaacgccttgagtggatgggatcgatacgaactgtggacaagtggacaaacgaacaaaagtacttacaacaagaagttacaaagggtcaaggacgtacaaccgaatttaacccgaaggggacaacacgtccgacgaaacacacgacctaacagtaggacgcgtagacgacacggaccttaggaacctagttaccgagaaacgaccgaacgggcttaggtagttagttacgtggttaacggaggttaccgggtagttagtcgtagggttagttnttagttaagtagtaacgtgtaccgttcgttcggttcgggtaacccggg

SEQ ID NO: 342977 - DNA, 664 bp, Homo sapiens
  misc_feature: GZ8MTXP01EPWF6.4.58.F03.1.454.CMB.2.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtgggctggaggtgaagagccgtgggcctgagtgagggtttccngcaaggtcttcgtggatacaccttnagttagttatactatactacgtgggtcgccgccgacgggcccccgaanaaacggtccgttagagtggagtggatcgatacaacgtcgtaggactaagtggaaccaaacaaactaaaattacttacaaacgaaggtaaacgttacgaaagggacaaggtacgtaccaacctaacgttaacccgaagggacaacacgtacccgacgaaacacgacgtaccctaacgagtaggacgtcgtagacgaccgacgtacccgtaggaacctacgtacgtaagaacgaccgtacggtaccttaggttagttaacgttacgttggtaacggaagggttaccgggtacgttaggtcgtagggttacttcgttaagttaagtagtcgtacgttcgttcggttcggttcggggtaaccccg

SEQ ID NO: 342978 - DNA, 600 bp, Homo sapiens
  misc_feature: GZ8MTXP01A07MR.4.58.F03.1.454.CMB.2.raw
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (541)..(541): a, c, t, g, unknown or other
  misc_feature (541)..(541): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatcctctttttggtggcagcagccacaggtgcccattcccaggtccagcttgtgcagtctggggctgaggtgaagagcctggggcctcgagtgtagggtttcctgcaaggtcttctggatacaccttnagttagttatactatacacgtgggtncgccgacggccccccggaanaaacgccttagacgtggagtgggatcgatcaactcgtggacaagtcggacaaacaactaaaatacttacaacaagtaagttaccgaagggaccaagacgtacaaccctattaccgaaggacacgactccgacgaacacacgacctaacgagtacgggagctgacgctaacggcctaggactactaccgtagaacgacgaacggtctgtagttacttacgtggttaacgagttaccgggtnttagtcgtgggattgttagttaatcgtgtacgttcgttcgttcggttcggggtaacccg

SEQ ID NO: 342979 - DNA, 599 bp, Homo sapiens
  misc_feature: GZ8MTXP01BSY2A.4.58.F03.1.454.CMB.2.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagagccgtggggcctnagtgagggtttccngcaaggcttntggatacaccttcagttagttatactatacactgggncgccacggcccccgganaaacgccttgagtggatggatcgatcaactcgtgctaagtggacaaacactaaaattactacacaagtaagttacgaagggacaagacgtaccaaccattaacccgagggacacactaccgacgaacacgacgcctacagtggacgctgacgcagccgtgaactatacgtagaacgcgtacggtcttgttgttactttacgttggttaacgacgggttcgggtacttacggtacgtgggttacttcgttaggttaagtacggttcgtaccgtttcgttcggtttaacggttcgggggtaacccgg

SEQ ID NO: 342980 - DNA, 654 bp, Homo sapiens
  misc_feature: GZ8MTXP01A6FI0.4.58.F03.1.454.CMB.2.raw
  modified_base (232)..(232): a, c, t, g, unknown or other
  misc_feature (232)..(232): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtgggctggaggtgaagagccgtgggcctgagtgtagggtttccngcaaggcttctggatactacttcagttagttatactatacactgggngcgccgacggcccccgaanaaacgtccttagagtggacgtggatcgatcgaactcgtaggacaagtcggacaaaacgaactaaaaatacttacaacgtaagtaaagttacgaagggacaagacgtaccaaccaacgttaccgaacggggacaacgactaccgacgaaacacaacgacctaacgagtacggacgctagacgactacggacctagaacctatacgtaagaaacgaccgacggtacttgttacgttaagtttcgtagggttaacgaacgggttcggggtacttacgggttacgtagggttattcgttaagtttaacgtaggttaacgttaccgttcggtttacgggttccggttcggggtaacccggg

SEQ ID NO: 342981 - DNA, 683 bp, Homo sapiens
  misc_feature: GZ8MTXP01BT6WM.4.58.F03.1.454.CMB.2.raw
  modified_base (218)..(218): a, c, t, g, unknown or other
  misc_feature (218)..(218): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (334)..(334): a, c, t, g, unknown or other
  misc_feature (334)..(334): n is a, c, g, or t
  modified_base (484)..(484): a, c, t, g, unknown or other
  misc_feature (484)..(484): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagagccgtggggcctnagtgtaggtttcctgcaaggtcttctggatactacttnagttattatactatacacgtgggcgcgccgacggacccccganaaacgccttgagtggagtggatcgtatcaactcgnggactaagtcggaactaaacaaactaaaattacttacaaacgtaaggtaaacgttaaccgaaaggggtaccaaggaacgttacccaaacctacgttaacccgagggaactaacactaccgacgaaacacacgacctaacgagtagggacncgtagaacgaccgaacggtcctacggaactaacgttacgaggaaaaccggtccgacgggtaccttgttaacgtttaacgtttaaccggttggttaacccggaggttaacggggtccttaaagggtcgtagggttacttcgttaagttaacgttaggtcgtaccgttcggttccggtttaacggttccggggtaacccgg

SEQ ID NO: 342982 - DNA, 558 bp, Homo sapiens
  misc_feature: GZ8MTXP01EWSIC.4.58.F03.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (424)..(424): a, c, t, g, unknown or other
  misc_feature (424)..(424): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctcagtgagggtttcctgcaaggcttctggatacacttcagttagttatactatacactgggtncgccaggcccccgganaaagccttgagtggatggatcgatcaactctgggcaatggacaaacacaaaatacttacaacagaagttacgaagggcaagagtcaccattaccgagggacacatccgacgaacacagcctacatggagctgancacgccgtgaacatactagaaacgacgaacgggcttgtagttatttaacgtgttaacggaggacgggtcttaaggtcgtaggggattcttagttaatagttgtacgtcggttcgttccggttggggtaacccgg

SEQ ID NO: 342983 - DNA, 621 bp, Homo sapiens
  misc_feature: GZ8MTXP01DVNMB.4.58.F03.1.454.CMB.2.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtggggctgaggtgaagagctgggcctnagtgaggttcngcagnttngatacncttnagtagtatactatacactgggncgccacggcccccganaaacgccttgagtggagtgggatcgatcaactctgggacaagtggacaaacgacaaaatacttacaacaagtaaacgtttaccaaaggggaccaagggaagtaccaaaccctaacgttaacccgaaggggaccaacactacccgacgaaacacgacgaccctaaacgagtaggacgtccagagccgagccggtagacctatcctagaacgacgacggtctagttggttaattaccgtggttaaccgaaggttacgggtcgttaaggtccgtaggggttaatttcgttaaggtttaataacggttcgtacgttcggttcgttcggttcggggtaacccgg

SEQ ID NO: 342984 - DNA, 606 bp, Homo sapiens
  misc_feature: GZ8MTXP01DN50F.4.58.F03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtggggctggaggtgaagagccgtgggcctnagtgtaggtttcngcaggcttngatacacttnagttagttatactatacactgggngcgccgacggccccccggaanaaacgccttggagtggagtggatcgatcaactcgtggacaagtggacaaacaataaaatacttacaanagtaaagttacgaagggcaaggacgtaccaacctaagttaacccgagggtaacacactaccgacgaaaccacgacgacctaacagtaggaagcgtagacggacacggacctaggaactagtaccgtagaacgaccgacggtcgtaggttagttagtttacgtggttaacggaggacgggtcttagtcgtgggttacttcgttagttaatagtcgtactcggttcgttcggttggggtaacccg

SEQ ID NO: 342985 - DNA, 611 bp, Homo sapiens
  misc_feature: GZ8MTXP01A4DRZ.4.58.F03.1.454.CMB.2.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttccngcaaggcttctggatacaccttcagtagttatactatacactgggngcgccacggacccccgganaaacgccttgacgtggatggatcgatcaactctggcaatggacaaacaacaaaatcttacaacagtaagttacgaagggacaagagtacaccattaccgagggacacatccgacgaacacagccctaacagtaggacgctagagccaggtccctaggaccataccgtaggaaacgacacgggtacttggtacgttaacgtttaacgttggtttaaccggaaggttaccggggtacttaacgggtcgtaggggttacttcgttaagtttaagtaagtcgtaccgttcggttcgtttccggttaacgggggtaaccccgg

SEQ ID NO: 342986 - DNA, 600 bp, Homo sapiens
  misc_feature: GZ8MTXP01ENL4Y.4.58.F03.1.454.CMB.2.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagagcactgtagcacgaccggtgctcgatttagtctgatcgagaagggaaagggacccaacaaccacatccctcctcagaagccccagagcacaacgcctcaccatggactggacctggaggatcctctttttggtggcagcagccacaggtgcccattcccaggtccagcttgtgcagtcgtggggctgaggtgaagaagcctggggcctnagtgagggtttccngcaaggcttctggatacaccttcagttagttatactatacactgggncgccacggccccganaaagccttgagtggatgggatcgatcaatctggcaatggacaacaaacaaaatacttacaacgagtaaagttacgaaagggaccaagagtaccacctaacttaaccgaggggacaacactaccgacgaaaccacacgccctaacagtagagctagacgcacgacctggaaccatacgagaacgacgacggtcgtgtaggttaacttcgttggttaacgaacgggttaccgggtacgttaaggttcggtaggggttacttcgttagttaatacgtgtaccgttcgttcggttaacggttggggtaacccgg

SEQ ID NO: 342987 - DNA, 588 bp, Homo sapiens
  misc_feature: GZ8MTXP01A5K9S.4.58.F03.1.454.CMB.2.raw
  modified_base (296)..(296): a, c, t, g, unknown or other
  misc_feature (296)..(296): n is a, c, g, or t
  modified_base (466)..(466): a, c, t, g, unknown or other
  misc_feature (466)..(466): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgtagggtttcctgcaaggcttctggatacaccttcagttagttatactatacactgggtgcgccgacggccccccgganaaacgccttggagtggagtgggatcgatcaactcgtggcaatggacaaacaacaaaatacttacacaagaaagttacgaaagggccaagacgtaccaacctattaacccgaggggtacacactccgacgaaacacgacgcctaacagtggagctgagcgagccgtagacntacgagaacgacgacggtcgtgtagtattcgttggtaacgtagggacggtcgttaggtcggtggttacgttgttagttaataggtcgtacgttcggttcgttcgggttcggggtaacccggg

SEQ ID NO: 342988 - DNA, 649 bp, Homo sapiens
  misc_feature: GZ8MTXP01DAGGR.4.58.F03.1.454.CMB.2.raw
  modified_base (142)..(142): a, c, t, g, unknown or other
  misc_feature (142)..(142): n is a, c, g, or t
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (587)..(587): a, c, t, g, unknown or other
  misc_feature (587)..(587): n is a, c, g, or t
tcagagcactgtagcacgaccggtgctcgatttagtctgatcgagaagggaaagggacccaacaaccacatcccctcctcagaacgcccccagagcacaacgcctcaccatggactggacctggaggatccttctttttggnggcagcagccacaggtcgcccattcccaggtccagcttgtgcagtcgtgggctgaggtgaagagcctgggcctnagtgtaggtttccngcaaggtcttgngatactccttnagttagttatactatacacgtggngccgccgacggccccccgaanaaacgccttaggagtggagtgggatcgattacaactcgtaggactaagtggacaaacaaactaaaattacttacgaaacaagtaaagttaccgaaaggggcaaggacgttaaccaaacccgtaaacgttaacccgaacggggaaccaaacgtacgtacccgaacggaaaccaacacgaccctaaagacgtaggaacgcgagaacgacacggaccctagaacctattaccgagaacgacgaccggtacgttgtaggttaatttacgttggttaacgaaggttaccgggtnttacggtacgtgggttacttgttagttaatagtcgtacgtcgttcgtcgttgggtaacccgg

SEQ ID NO: 342989 - DNA, 620 bp, Homo sapiens
  misc_feature: GZ8MTXP01ADFD8.4.58.F03.1.454.CMB.2.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtcgcccattcccaggtccagcttgtgcagtctggggctggaggtgaagagccgtgggcctcagtgagggtttccngcaggtcttcgnggatacaccttnagttagttatacgtatacatgggtgcgccacggcccccgaanaaacgccttagagtggatgggatcgatcaactcgtgcaatggacaacaanaaactctacacgaagtaagtacgaagggacaagatacaccattaccgagggacacactaccgaccgaaacacgacgccctaanacgttggacgcctaggacgaccaacgccgttagaacncgttacgaacggaacgacgaaccggtcttacggttgttaaacgtttcccgtgggtttaaccgacggggttaacggtaccgttaaggttccgttagggttacttggttagttaagtgtcgtacgttcggttcgttcggttcgggtaacccggg

SEQ ID NO: 342990 - DNA, 590 bp, Homo sapiens
  misc_feature: GZ8MTXP01A1GZ2.4.58.F03.1.454.CMB.2.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtgagggtttcctgcaaggcttctggatacaccttcagttagttatactatacactgggtncgccgacggcccccggaanaaacgccttgagtggatgggatcgatcaactctgcaatggacaaacacaaaatacttacaacagaacgttacgaagggacaagacgttaccaacccgtaatttaacccgaggggaccacgactacccgacgaaacacacgaccctaacgatggaacgctagagacagcctagacactcgagaacgacacggtctgtagtacgtttaccgtgttaacggaagcggggtcttaggttcgtgggttacgttgttagttaatagtcgtacgttcgttcgttcgttcgggtaacccgg

SEQ ID NO: 342991 - DNA, 649 bp, Homo sapiens
  misc_feature: GZ8MTXP01ADS96.4.58.F03.1.454.CMB.2.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctggaggtgaagagccgtggggcctnagtgtagggtttcctgcaggtcttctggatactacttnagttattatactatacagtggngcgccacggcccccgaanaaacgtccttggagtggatggatcgatcaactcgngacagtggacaaacaataaactctacanagtaagtacaagggcaagatccacagtaccgaggacacactaccgacgaacacacgcctaagagtggagtcagacgaccgacggtccctaggacctacgtacgtaacggaaacgaccgtacgggtcttaggttagttaaacgttacgttcggttaacgggaacggttaccgggtacgttaacgggttccggtaggggttacgtttacggttaacggttttaagtacgggttcggttaacccggttccggggtttaccggtttccggggttaaccggggggtaacccccggg

SEQ ID NO: 342992 - DNA, 649 bp, Homo sapiens
  misc_feature: GZ8MTXP01EMLUJ.4.58.F03.1.454.CMB.2.raw
  modified_base (283)..(283): a, c, t, g, unknown or other
  misc_feature (283)..(283): n is a, c, g, or t
  modified_base (559)..(559): a, c, t, g, unknown or other
  misc_feature (559)..(559): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtgggctggaggtgaagagccgtggggcctgagtgtacgggtttcctgcaaggtcttcgtggactacaccttcaagttagtatactatacacgtgggnccgccgaccggccccgaacaaacgtccgttgaggtggagtaggactcgatacgtaactcgtacgggactaagtcggaacaaacaaactaaaattaccttacaaacgaagtaaacgttaccgaaagggactaagggacttacccaaaccgtacgttaaaccccgaggggacaacgacgtacccgacgaaacctacgacgaccttaacgagtacgagccgtgacgacgacgtccagactacgtcgaggaacgtcgacggtcttaggtacttagttcgnggttaacgaaggggacccggtagttggtacgtgggttattgttaagttgtacgtgttaccttcgggttcgttcggttccggggtaaccgg

SEQ ID NO: 342993 - DNA, 677 bp, Homo sapiens
  misc_feature: GZ8MTXP01A5ULY.4.58.F03.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattccccaggtccagcttgtgcagtctggggctgaggtgaagagcctgggcctnagtgaggtttcctgcaaggcttcgtggatacaccttcagttagttatactatacactgggncgccaggcccccgganaaaggccttagagtggagtggatcgatcaaactcgtggcaagtggacaaactaacaaaaattacttaccaacgaagtaaacgttacgaaagggggacaacggaagttacccaaacctagtttaacccgaaggggaacctaacgactacccgacggaaccaacgacgacccttaacagtaggacgtctacgagccaaggcccttaggaaccctataccgtacgaaagccgaacgggccttaggtagttaaacgtttacgttcgggtttaaccggagggttaccggggtcgttaggttacccgttagggggttaactttcggttaagtttaagttaggtcgtaaccgttcggggttccggtttaaccgggttcgggggttaaccccgg

SEQ ID NO: 342994 - DNA, 622 bp, Homo sapiens
  misc_feature: GZ8MTXP01EJBMY.4.58.F03.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtgggctggaggtgaagagcgtgggcctgagtgaggttcngcaggcttngatacncttnagttagtatactatacacgtgggcncgccgacggcccccggaanaaacgccgttgagtggagtgggatcgatcaacgtcgtggacaagtcggacaaacaactaaaatacttacanaagtaagttacgaagggacaaggactaccaactacttaaccgaaggggactacactacccgaacgaacacgacgacctaacgagtaggaacgcgagacgacgacgaccggtagacatacgtagaacgacgacggtcttgttacggttatttacgtgttaacggaacggttacgggtacgtttaggtcgttagggttacgttcgttaagtttaagttacggttgtaccgttcggttaccggttcggttcggggtaaccccgg

SEQ ID NO: 342995 - DNA, 666 bp, Homo sapiens
  misc_feature: GZ8MTXP01DD1H2.4.58.F03.1.454.CMB.2.raw
  modified_base (141)..(141): a, c, t, g, unknown or other
  misc_feature (141)..(141): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatcctctttttggnggcagcagccacaggtcgcccattcccaggtccagcttgtgcagtcgtgggctggaggtgaagagccgtggggcctcagtgtagggtttccngcaaggcttngatacacttcagttagttatactatacactgggtgcgccgacggacccccgganaaagtccttagaggtggacgtgggatcgatcaactcgtgcaagtggacaaacgaaacaaatactacaacagaacgttacgaagggacaagacgtcaaaccgattaccgagggtacacactccgacgaacacgagtaccctaacgagtacggacgtacgacgaacggacgaccggtacccgtaggtaaacctaacgttacgtaacggaaacgaaccgtaccgggtaacttaggtttacgttaaacgtttccgttaggttaacgggtaacgggttaccggggtacgtttacggtcgggtagggttaactttcgttaaggtttaagtacgttcggtacgttcggttacggtttcggaacggggttaacccgg

SEQ ID NO: 342996 - DNA, 638 bp, Homo sapiens
  misc_feature: GZ8MTXP01DJYKY.4.58.F03.1.454.CMB.2.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttttggtggcagcagccacaggtgcccattcccaggtccagcttgtgcagtctggggctgaggtgaagaagcctggggcctnagtgagggtttccngcaaggcttctggatacaccttcagttagttatactatacatgggncgccacggcccccgganaaagccttgagtggatggatcgatcaactcnggcaatggacaaacacaaaatacttacacaagaaagttacgaaaggggacaaggagtacaaaccctacttaaccgaaggggtaacaacgactacccgaccgaaacacaacgaccctaacgacgtggaagctagacgacacggccctaggaactagtactaaggaacgaccgacggacttggttagttaactttacgtggtttaacggaagttaccggggtcttaggttaccgttaggggttacttcgttaaaggttttaagtaacggttcgttacgttacggttcccggtttcggttaacgggggtaacccggg

SEQ ID NO: 342997 - DNA, 738 bp, Homo sapiens
  misc_feature: GZ8MTXP01E2S39.4.58.F03.1.454.CMB.2.raw
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctggggcctcgagtgtagggtttccngcaaggtcttctggatactacttcagttagttatatatacacgtgggcgcgccgacggacccccgaanaaagtccttagagtggatgtagatcgatacaacgtctaggacaagtcggaacaaacaaactaaaacttacttacaacgtaagtaaacgttaaacgaaggggaaccaaggaacgtaccaaccctaacttaaccccggaaggggaacccaaccaactaccccggaaccggaaaccaaccgaacgtacccctaaacgaacgttacgggaacgaccgtaacggaacgaccgtaacgggggaccccttaacggaacctacgtttacgtaaggaaaccggaaccgtaaaccgggtccgttaaggtttagttaacgtttaacgtcgggtttaacgggaacggggtaccggggttacgttaaggttccgttaggggttacttaccggtttaaagtttacgtaagtacgttaccggttccggtttcggtttccgggtaacccggggg

SEQ ID NO: 342998 - DNA, 718 bp, Homo sapiens
  misc_feature: GZ8MTXP01BBHHD.4.58.F03.1.454.CMB.2.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtggggctgaggtgaagagcctgggcctnagtgaggtttcngnagtctngatacncttnagtatatactatacacgtgggncgccgacggaccccganaaacgtcttagagtggagtggatcggatacaactcgtaggacaagtcggaacaaacaactaaaattacttaccaaacgaaggtaaaacgttacgaaaacggggacaaggtaaccgttacccgaaaccctaaagtttaaccccggaaaggggaacctaaaccgtaccgtacccggaaaccggtaaaccaacgaaaccgtaccctaacgtacggttagggacgtacgacgaagcaacggcctaagtaccgatacgaagaaacgaccgtaacggtgttaggttaccggttaactttggttagggtaaccgtaacgggggaccgggttacgtttaggaccgggtttagggttaacgttcggttttaaaggttaattacgggttaacgtaccgggttcggtttccggggtttaacgggttaacgggggtaacccccgg

SEQ ID NO: 342999 - DNA, 558 bp, Homo sapiens
  misc_feature: GZ8MTXP02F3U3K.4.58.F03.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (434)..(434): a, c, t, g, unknown or other
  misc_feature (434)..(434): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttgtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggccccccgganaaacgccttgagtggatgggatcgatcaactctggcaatggacaaacaacaaaaatacttacaacaagaaagttacaaggggacaggagtacaaccattaacccaggggacacatcccgacgaaacacagccctacatgganctagagcagcctaggacatctagaaacgacacggctaggtgtatttacgtgttacggaggtacgggcttaggtcgtaggggatcgttagttaagtagtgtactcgtacgttcgtggggtaccgg

SEQ ID NO: 343000 - DNA, 518 bp, Homo sapiens
  misc_feature: GZ8MTXP02J07L3.4.58.F03.1.454.CMB.2.raw
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcaacagaagttacagggcagagtcaccattaccagggacacatccgcgaacacagccctacatggagctgagcagccctgacatctagaagacacggctgtgtattctgttcgagacggctagtcgtgggatcgtaagttaagtagtcgtactcgtcgtttcgtcggggtaccg

SEQ ID NO: 343001 - DNA, 636 bp, Homo sapiens
  misc_feature: GZ8MTXP02JN7TK.4.58.F03.1.454.CMB.2.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagagcctggggcctcagtgagggttcctgcaaggcttctggatacaccttcagtagttatactatacactgggtncgccaggcccccgganaaagccttgagtggatgggatcggatcaaactctggcaatgggacaaccaaanaaaatactacaacaagtaaagttacgaggacagacgtacaacctataaccgaggacactactcccgaacgaaacacgacgtacccgtaacaggtacggaacgactaggaacgaccgacggtaccctacggaaacctacgtaccggtaaaggaaaccgtaccggacggtcgttagttacgttaacgttacgtacggttacggacgggtaccggtacgttacggtacgtagggtaacgttacgttaagttaagtacgtacgtacgttccggtttcggttccgggtacggggtaccg

SEQ ID NO: 343002 - DNA, 521 bp, Homo sapiens
  misc_feature: GZ8MTXP02HNFM1.4.58.F03.1.454.CMB.2.raw
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagagcactgtagcacgaccggtgctcgatttagtctgatcgagaagggaaagggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagctgggcctnagtgagggttcctgcaaggcttctggatacaccttcagtagttatactatacactgggtncgccaggccccgganaaagcctgagtggatgggatcgatcaactctggcaatggacaaacacaaaaatattacaacagaaagttacagggcagagtcacattaccagggacacatccgagaacacagcctacatgagangaganagacncaanatacagagacgacgcgtgtagtatatagtacgtagacggacgtagtcgtagtacgtagtagttaagtagtacgtacgtacgtcgttcgtacggtacg

SEQ ID NO: 343003 - DNA, 672 bp, Homo sapiens
  misc_feature: GZ8MTXP02H0MI2.4.58.F03.1.454.CMB.2.raw
tcagagcactgtagcacgaccggtgctcgatttagtctgatcgagaagggaaaggggacccaacaaccacatcccctcctcagaagcccccagagcacaacgcctcaccatggactggacctggaggatccttctttttggtggcagcagccacaggtgcccattcccaggtccagcttgtgcagtcgtggggctggaggtgaagaagccgtggggcctgagtggtagggtttcctgcaaggtcttcgtggatactaccttcagtagttatactatacacgtgggtgcgccgacggcccccgaacaaagtccttagagtggagtgggatcgatcaactcgtggacaagtggaccaaacaaactaaaaattacttacaacaagtaaagttaacgaggggacaggacgtacaacctaacgttaaccgaagggaacaaccgactcccgaacgaacaacacgcccttaaacagtaggacgcgtaggacgacgacgccgtacggactactcgtagaaacgaacgacgggtctaggttacgttaacgtttaacgttcggtttacggaacggggttaccggggtacgttaaacggttccggttagggggaactttacggtttagttaagttagttacggtacgtttacggttccggtttcggttacgggggtaacccgg

SEQ ID NO: 343004 - DNA, 556 bp, Homo sapiens
  misc_feature: GZ8MTXP02J3YDZ.4.58.F03.1.454.CMB.2.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (413)..(413): a, c, t, g, unknown or other
  misc_feature (413)..(413): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagtctggggcctnagtgagggtttcctgcaaggcttctggatacaccttnagtagttatactatacactgggtncgccaggcccccggaanaacgctgagtggagtggatacgatacaactcgagacagtagacaacaaacaaatactacacagaagtacgaggacgagacgtacacactacgacgacacacaccgacgaacacacacacanagagacgagagacacgcacgacatacgtacgaacgacgacgacgtagtagttattacgtacgtacggtacggacggtacgtacgtacgtacggtacgtacgtagttaagtacgtacgtacgtacgtcggtcggtacggtacgg

SEQ ID NO: 343005 - DNA, 529 bp, Homo sapiens
  misc_feature: GZ8MTXP02J3ISH.4.58.F03.1.454.CMB.2.raw
  modified_base (293)..(293): a, c, t, g, unknown or other
  misc_feature (293)..(293): n is a, c, g, or t
  modified_base (441)..(441): a, c, t, g, unknown or other
  misc_feature (441)..(441): n is a, c, g, or t
  modified_base (505)..(505): a, c, t, g, unknown or other
  misc_feature (505)..(505): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccaggcccccgganaaagccttgagtggatgggatcgatcaactctgcaatggcaaacacaaaatacttacacagaagttacagggcagagtcaccataccagggacacatccgacgaacacacgcctacatggaagctagagcagcctgacatcgtagaanacgacggctgtagttatacgtgttaccgagacggctaaggtctgggattcgtagttaagtagtnacttcgtcgttcgtcggggtaccg

SEQ ID NO: 343006 - DNA, 527 bp, Homo sapiens
  misc_feature: GZ8MTXP02J0FVN.4.58.F03.1.454.CMB.2.raw
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccaggcccccgganaaagccttgagtggatgggatcgatcaactctggcaatggacaaacaacaaaatacttacacagaaagttacaggggcagagtcaccataccagggacacatccgacgaacacagccctacatggagctgagcagcctgacatctagaagacacggctgtatattactgttacgaggacgggctagtcgtgggatcgtagttaagtagtcgacttcgtcgttacgtcggggaccg

SEQ ID NO: 343007 - DNA, 553 bp, Homo sapiens
  misc_feature: GZ8MTXP02FUQJD.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacaacaaaatattacacagaagttacaggcagagtcacataccaggacacatccgcgaacacagcctacacgtaggagctagagacagccctgacatcgtagaacgacacgggcttaggtgtaacttacgtgttacgaggtacgggcttaacgttcgtacggggtaatcgttaagttaagttagtacgtacgttcgttacggttcgttcgggggacccgg

SEQ ID NO: 343008 - DNA, 554 bp, Homo sapiens
  misc_feature: GZ8MTXP02HQVN6.4.58.F03.1.454.CMB.2.raw
  modified_base (415)..(415): a, c, t, g, unknown or other
  misc_feature (415)..(415): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagcctgggcctcagtgagggttcctgcaaggcttctggatacaccttcagttagttatactatacactgggtgcgccacggcccccggacaaagccttgagtggagtgggatcgatcaactctggcaatggacaaacacaaaatacttacacagaagttacagggacagagtcacctattaccgagggacacatccgacgaacacagccctaanactggagctagagcacgcctgacatcagaacgacacggctgtagttattacgtggttacgacggtacgggtctaggttcgtacggggtattcgttagttaagtagtacgtacgtcggtttcgttcggttcggggacccg

SEQ ID NO: 343009 - DNA, 550 bp, Homo sapiens
  misc_feature: GZ8MTXP02IHWTH.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagttgagggtttcctgcaaggcttctggatacaccttcagtagttatactatacactgggtgcgcaggcccccggacaaagccttgagtggatgggatcgatcaactctggcaatggacaacaacaaaatacttacaacagaagttacaggcagagtacaccaattaacccagggaacacataccgacgaaacacagccctaacataggagctagacgcacggcctagactatctagaagacaacggctgtagtattacgtgtttcgaggacgggtctagtcgtagggacttcgtagttaagtaggtagtacgtcgttcgttcgtcggggtacccg

SEQ ID NO: 343010 - DNA, 613 bp, Homo sapiens
  misc_feature: GZ8MTXP02GPZSI.4.58.F03.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccgganaaagccttgagtggagtggatacgtactacaactcgtgacagtcgaacaacaaactaaaatactacaacgaagtaacgtacgaggacaggactacaactactaaccgaggacactacgaccgaacgaacacgacgaccctaanagagacncgagacgacgacgacgtacgactacgtacgaagaaacgacgacggtacgtagttacgttaacgttacgttcggtacggacgggtacggtacgttacggttcggtacggtacttacgtttaagttaagttacggtacgtacgttcggttacggttacggggtacgggtaaccgg

SEQ ID NO: 343011 - DNA, 525 bp, Homo sapiens
  misc_feature: GZ8MTXP02HHIKY.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctgggcaatggacaacacaaaatacttacacagaagttacaggggcagagtcaccattaccagggacacatccgcgaacacagcctacatggagctgagcagcctgacatctagaagacacggctgtgtattactgttacgagcggctaggtcgtgggtactcgttagttaagtgtagtactcgttcgttcgtggggtacccg

SEQ ID NO: 343012 - DNA, 566 bp, Homo sapiens
  misc_feature: GZ8MTXP02FJP2L.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagaagccgtggggcctcagtgagggtttcctgcgaaggcttctggataccaccttcagttagttatactatacactgggtgcgccgacggcccccggacaaacgccttgagtggagtgggatcgatcaactctggcaagtggacaacacaaaatacttacacagaagttacaggcagacgtacactacttaccagggacacactccgacgaacacacgccctacagtggaacgctagacgcgaacgcctaggactattacgagaacgacgacggtctagtgtatttacgtggttacgacggaccggtgtagttcgtgggtaactgttagtaagtagtgtacgtcgttcgttcggtgggaacccgg

SEQ ID NO: 343013 - DNA, 513 bp, Homo sapiens
  misc_feature: GZ8MTXP02FRHU5.4.58.F03.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccgganaaagccttgagtggatgggatcgatcaactctggcaatggcaacacaaaatacttacacagaagttacagggcagagtcacattaccaggacacatccgcgaacacagcctacatggagctagagcagcctgacatctagaaagcacggctgtgtatacgtgttacgagacgggctagtctgggactcgtagttaatagtgactcgtcgttcgtggggtaccg

SEQ ID NO: 343014 - DNA, 511 bp, Homo sapiens
  misc_feature: GZ8MTXP02GKGAX.4.58.F03.1.454.CMB.2.raw
  modified_base (274)..(274): a, c, t, g, unknown or other
  misc_feature (274)..(274): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccggacaaagccttgagtggatgggatcgatcaactctggcaatggacaaacacaaaaatacttacaacagaattacagggcagagtcaccattaccagggacacatccgagaacacagacctacactgganctgagcagcctgacatctagaacgacaggctgtgtattacngttcgagacggctagctggactctagtaatagtgactcgtacgtcgtgggaccg

SEQ ID NO: 343015 - DNA, 564 bp, Homo sapiens
  misc_feature: GZ8MTXP02HR3WA.4.58.F03.1.454.CMB.2.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (457)..(457): a, c, t, g, unknown or other
  misc_feature (457)..(457): n is a, c, g, or t
tcagagcactgtagcacgaccggtgctcgatttagtctgatcgagaagggaaaggggacccaacaaccacatctctcctcagaagcccccagagcacaacgcctcaccatggactggacctggaggatcctcttttttggtggcagcagccacaggtgcccattcccaggtccagcttgtgcagtctggggctgaggtgaagagcctgggcctnagtgagggtttccngcaaggcttctggatacaccttcagttagttatactatacacgtggtgcgccacggcccccgganaaacgccttgagtggatgggatcgatcaactctggcaatgacaaacaacaaaatntacaacagtaagttacgaggcagagtcaccattaccgaggacacatccgacgaacacagacctacgataggagtcagagcagccctagacatactagaacgacgacggnttacgtagttacttaacgttgttacggtaggacgggtactaggttcgtagggtattacgttaagtttagtagttacgtacgtttcggttacgtttcggtaccggggg

SEQ ID NO: 343016 - DNA, 532 bp, Homo sapiens
  misc_feature: GZ8MTXP02FWSFO.4.58.F03.1.454.CMB.2.raw
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccaggcccccganaagccttgagtggatgggatcgatcaactcgtggcaagtggacaacacaaaatactacacagaagttacagggcagagtcacattaccgagggacacatccgacgaaacacagccctacactggacgctgagcagcctgacatctagaacgacacggctggtgtattacgtgttacgagacgggctaggtcgtagggactcgtagttaagtagtcgtacgtcgttcgtcgtcgggtaccg

SEQ ID NO: 343017 - DNA, 567 bp, Homo sapiens
  misc_feature: GZ8MTXP02G6T1G.4.58.F03.1.454.CMB.2.raw
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (416)..(416): a, c, t, g, unknown or other
  misc_feature (416)..(416): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccganaaagcctgagtgatgggatcgatcaactctggcaatggacaacacaaaatattcaacagaagttacagggcagagtcaaccattaccaggacacgatccgacgaaacacagccctacatgggaacncagacgacacgtccagacatacgaagaacgacgacggtctaggtacgttaacttacgtcggttacgacggtacgggtactaggttacgtacgggtacttacgtaagttaagtagtacgtacgttacggttcggttacggtacggggtaccg

SEQ ID NO: 343018 - DNA, 576 bp, Homo sapiens
  misc_feature: GZ8MTXP02GPNTC.4.58.F03.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (423)..(423): a, c, t, g, unknown or other
  misc_feature (423)..(423): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccacggcccccganaaacgccttgagtggatgggatcgatcaactctggcaagtggacaaacacaaaatacttacaacaagaagttacagggcagagtcaacctattacccgagggacacactaccgacgaacacagaccctaanacgtaggacgctagacgcagcctagactagtacctagaaacgacgacggtctggtagttatttacgtggtttaccgaggtacgggtctaggtcgtagggaacttcgttaagttaagtacggtgtacgtcggtttacgttcgtcggggtacccg

SEQ ID NO: 343019 - DNA, 535 bp, Homo sapiens
  misc_feature: GZ8MTXP02G3VIW.4.58.F03.1.454.CMB.2.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctnagtgagggtttccngcaaggcttctggatacacctttcagttagttatactatacacgtgggtncgccacggcccccgganaaacgccttgagtggagtgggatcgatcaactctggcaatggacaacanaaatntacacagaagttacagggacaggactcactagttaccagggacacgatccgacgaacacacgcctacagtgaagcagagacagcctagacatacgagaaacacgacggactgtagttattatgttacgaggacggctagtcgtggactcgttagtaagtagtcgtacgtcgtcgttcgagggtaccg

SEQ ID NO: 343020 - DNA, 580 bp, Homo sapiens
  misc_feature: GZ8MTXP02J3QJD.4.58.F03.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagagcctgggcctcagtgagggtttccngcaaggcttctggatacaccttnagtagtttanactntacactgggtgcgccacggcccccgganaaagccttgagtggatgggatcgatcaaactctggacaagtggacacaaacaaaatactcacngaagttacgagggcngtatcacctattaccngggacacactccgacgaacncagccctanagtggagctagacgcacgtccctgacatccgtagaacggacacgggcttaggttattaacgtttacttggtttaccgaggtaccgggggtacttaaggttcgttaggggtacttcgttagtttaagtagtcgtacgttcgtccggtttcgacgggggtacccgg

SEQ ID NO: 343021 - DNA, 570 bp, Homo sapiens
  misc_feature: GZ8MTXP02JVR1Q.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagagcctggggcctcagtgagggtttcctgcaaggcttctggatacacctttcagttagttatactatacactgggtgcgccacggcccccggacaaacgccttgagtggatgggatcgatcaactctggcaagtggacaacacaaaatactacacagaacgttacaggggacagacgtacaccattaccgagggacacactaccgacgaacacacgccctacagtaggagctagacgcagccctagacattaccgagaacgacgacggctgtagttattacgtgttacggaggtacgggtctaggtcgtagggtacttagttaagttaagtagtacgtacgttcggttcgtttacggtcggggtaacccgg

SEQ ID NO: 343022 - DNA, 518 bp, Homo sapiens
  misc_feature: GZ8MTXP02JIYS5.4.58.F03.1.454.CMB.2.raw
  modified_base (363)..(363): a, c, t, g, unknown or other
  misc_feature (363)..(363): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcggatcaactctggcaatggacaacacaaaatatacacagaagttacaggcngagtcaccattaccagggacacatccgacgaacacagcctacatggagctgagcagcctgacatctgaacgacacggctgtgtattactgttacgaggacgggctaggtcgtgggactcgtagttaagtagtcgactcgtcgttcgtgggtcccg

SEQ ID NO: 343023 - DNA, 566 bp, Homo sapiens
  misc_feature: GZ8MTXP02H6Y07.4.58.F03.1.454.CMB.2.raw
  modified_base (289)..(289): a, c, t, g, unknown or other
  misc_feature (289)..(289): n is a, c, g, or t
  modified_base (425)..(425): a, c, t, g, unknown or other
  misc_feature (425)..(425): n is a, c, g, or t
tcagagcactgtagcacgaccggtgctcgatttagtctgatcgagaagggaaagggacccaacaaccacatccctcctcagaagccccagagcacaacgcctcaccatggactggacctggaggatcctctttttggtggcagcagccacaggtgcccattcccaggtccagcttgtgcagtctggggcgtgaggtgaagaagcctgggcctcagtgaggtttcctgcaaggcttctggatacaccttcagtagttatactatacactgggtgcgccaggcccccgganaaagccttgagtggatgggatcgatcaactctggcaatggacaaacaacaaaatacttacaacagaaagttacaggggtacagagtacaccattaccgagggacacactccgacgaacacacgccctaacatggancgtgacgcagacctgactatctagaaacgacacggtctagttagtacttacgtgttacggaggtacgggtctaaggtcgtagggacttcgttaagttaagtaggttcgtacgttcgttccggtttcgtacgggggtacccg

SEQ ID NO: 343024 - DNA, 578 bp, Homo sapiens
  misc_feature: GZ8MTXP02I3GQS.4.58.F03.1.454.CMB.2.raw
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
  modified_base (428)..(428): a, c, t, g, unknown or other
  misc_feature (428)..(428): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctgggcctcagtgagggtttcctgcaaggcttctggatacaccttcagtagttatactatacactgggtgcgccacggcccccganaaacgccttgagtggatgggatcgatcaactctggcaatggacaaacaacaaaatnttacaacagaaacgttacaggggacagagtacaaccattacccgaagggaccaacactccgacgaaacacgacgaccctanacgtggagcgtagacgcaacgtcctgaactatcgtagaaacgaccgacggtcgtagtgttaattacgttggttacgaggtacgggtcttaggtcgtgggtaactgttaagttaagtacgttcgtactcgttcggttcgtcggggtacccg

SEQ ID NO: 343025 - DNA, 687 bp, Homo sapiens
  misc_feature: GZ8MTXP02HX13E.4.58.F03.1.454.CMB.2.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (487)..(487): a, c, t, g, unknown or other
  misc_feature (487)..(487): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggtcttcgnggtatactaccttcagttagttatactatacacgtgggtgcgccgacggcccccgaanaaagccttgagtggagtgggatcggatccgaactcgtaggacaagtggacaaacaactaaaatacgttacaacgtaagtaaacgttaacgaggggacaggtaacgtaccaaaccctacgttaaaccccgaaggggaaacccaacgtactacccgacgaaaccacgacgaccctaacgagtcgggaanccgtagaacgaccgacggaccttaggaacacgttacgtagaaacgaccgacggtacttaggtacgttaacgtttaacgtcggtttacggaacgggttaccgggtacgttaacggtcgttacggggtaatttaccgttaaggtttaacgtaggttacgtaaccggttcggtttccggtttacggttacgggggaaccccgg

SEQ ID NO: 343026 - DNA, 658 bp, Homo sapiens
  misc_feature: GZ8MTXP02GWBNM.4.58.F03.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttcttttggtggcagcagccacaggtgcccattcccaggtccagcttgtgcagtctggggctgaggtgaagagcctggggcctcagtgagggtttcctgcaaggcttctggatacaccttcagtagttatactatacactgggtncgccacggcccccgganaaacgcctgagtggagtgggatcgatcaactcgtggcaagtggacaaacaactaaaatacttacaacaagtaacgttacgaggggacaggactacaacctacttaccgaagggaccaacacgtacccgaccgaaacacacgaccctaacgagtaggacgacgtagacgacgacgacccgtaggaacctagttacgaacgaaacgaaccgtaccgggtcgttacggttagttaacgtttacgttacggtttacggaacgggtaccggggtacgttaacggttccggttacggggtactttacgttaaggtttaagtacggttacggtacgtttccggttcggtttaccgggtacgggggtaacccgg

SEQ ID NO: 343027 - DNA, 616 bp, Homo sapiens
  misc_feature: GZ8MTXP02JBEMA.4.58.F03.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (433)..(433): a, c, t, g, unknown or other
  misc_feature (433)..(433): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccacggcccccgganaagcctgagtggatgggatcgatcaactcgtggcaatcggacaaacaacaaaatacttacaacaagtaagttacaaggggccaggacgtacaacctaattacccgaagggaccacacgtaccgacgaacacacgaccctanagtggagctagacacgagtccctaggacctatcgtagaaacgaccgaacgggtcttacggttagttaactttacgtaggtttaccggaagggtaccggggtaccttaagggttccgtaggggtacttacgttaagttaagtaggttcgtacgttcgtccggtttcggtacgggggtaaccccg

SEQ ID NO: 343028 - DNA, 557 bp, Homo sapiens
  misc_feature: GZ8MTXP02GBN1Y.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagaagcctggggcctcagtgagggtttcctgcaaggcttctggatacaccttcagtagttatactatacactgggtgcgccacggcccccggacaaacgccttagagtggatgggatcgatcaactctggcaagtggacaacaacaaaatacttacacaagtaagttacagggacagagtacaaccaacttaccgaggacaacactccgacgaaacacagcctaacatggaagctagagacacggcctagacatactagaagactaacggctagtgtatacgtgttacgacgacggtcgtagtcgtgggtacttgttagttaagtagtacgtacgtcgtcgttcgtcgggacccgg

SEQ ID NO: 343029 - DNA, 630 bp, Homo sapiens
  misc_feature: GZ8MTXP02IQOKN.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctcagtgagggtttcctgcaaggcttcgtggatacaccttcagttagttatactatacacgtggtgcgccgacggcccccgaacaaagccttgagtggagtgggatcgatcaaactctaggacaagtggacaaacaaacaaaattacttacaacaagtaaagttacgaagggacaggacgtacaacctagttaacccgaagggacacactccgacgaaaccacacgaccctacagtacggagctagacgacaacgccgtagactatacgtagaaacgaccgaacggcttaggttagttaacttacgttacggttacggtacggacggggtacttaacgggttcggttaggggtacttacgttaagtttaagttacggtacggtacgttcggttacgtttccggtacggggtaaccccggg

SEQ ID NO: 343030 - DNA, 529 bp, Homo sapiens
  misc_feature: GZ8MTXP02G4MBR.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaagggcttctggatacaccttcagtagttatactatacactgggtgcgccaggcccccggacaaagccttgagtggatgggatcgatcaactctggcaatggacaacacaaaatactacacagaagttacagggcagatcaccattaccagggacacactccgacgaacacagccctacatggagcctagagcagccctagacatctagaacgacacgggctgtagtattacgtgttcgagacgggctagtctagggactcgtaggtaatagtagtactcgtcgttcgtaggggtaccg

SEQ ID NO: 343031 - DNA, 540 bp, Homo sapiens
  misc_feature: GZ8MTXP02GL5YL.4.58.F03.1.454.CMB.2.raw
  modified_base (291)..(291): a, c, t, g, unknown or other
  misc_feature (291)..(291): n is a, c, g, or t
  modified_base (425)..(425): a, c, t, g, unknown or other
  misc_feature (425)..(425): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccaggcccccgganaaacgcctgagtggatgggatcgatcaactctggacaatggacaacactaaaatcttacacaagaagttacagggacagtacgtcaaccattaaccagggacacatccgacgaacacagccctacagtggaacnctgagcagcctgacatcgtagaacgacacggctgtagtattactggttacgaggtacggctagtcgtaggactcgtagttaagtgtcgtacttcggtacgtcgtacggggtaccg

SEQ ID NO: 343032 - DNA, 519 bp, Homo sapiens
  misc_feature: GZ8MTXP02HDKLU.4.58.F03.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccgganaaagccttgagtggatgggatcgatcaactctggcaatggacaacacaaaatacttacacagaagttacaggcagagtcaccattaccaggacacatccgacgaacacagcctacatggagctagagacagcctgacatcgtagaagacacggctgtgtatactgttacgagacggctaggtctgggactcgtagtaagtagtcgactcgtcgttcgtcgggtaccg

SEQ ID NO: 343033 - DNA, 587 bp, Homo sapiens
  misc_feature: GZ8MTXP02JIK4P.4.58.F03.1.454.CMB.2.raw
  modified_base (298)..(298): a, c, t, g, unknown or other
  misc_feature (298)..(298): n is a, c, g, or t
  modified_base (454)..(454): a, c, t, g, unknown or other
  misc_feature (454)..(454): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagccgtggggcctcagtgagggtttcctgcaaggtcttctggatacaccttcagttagttatactatacactgggtgcgccgacggcccccgganaaacgccttagagtggagtgggatcggatcaactcgtggacaatggacaaacaacaaaatactacaactagtaaacgttacaggggacagactacaacctaattaccgaacggacacgactcccgacgaaacacacgacctacagtagagctagancacgctgacatcagaacgacgacgctagtattaactcgtgttacgagtacgggtactacggtcgtagggtacttagttagttaagtacggttacgtaccgttcggttcggtttacgggtacggggtaccccgg

SEQ ID NO: 343034 - DNA, 566 bp, Homo sapiens
  misc_feature: GZ8MTXP02I078J.4.58.F03.1.454.CMB.2.raw
  modified_base (229)..(229): a, c, t, g, unknown or other
  misc_feature (229)..(229): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
  modified_base (450)..(450): a, c, t, g, unknown or other
  misc_feature (450)..(450): n is a, c, g, or t
  modified_base (493)..(493): a, c, t, g, unknown or other
  misc_feature (493)..(493): n is a, c, g, or t
tcagagcactgtagcacgaccggtgctcgatttagtctgatcgagaagggaaaggggacccaacaaccacatccctcctcagaagcccccagagcacaacccctcaccatggactggacctggaggatcctctttttggtggcagcagccacaggtgcccattcccaggtccagcttgtgcagtctggggctgaggtgaagaagcctggggcctcagtgagggtttccngcaaggcttctggatacaccttcagttagttatactatacactgggtgcgccaggcccccganaaagccttgagtggatgggatcgatcaactcgnggacaatggacaaacacaaaatattaccacagaagttacaggcagngtcaccattaccgagggacacactccgacgaacacagacctacagtcggagctgagcagcctagactatctaggaaacncgacggcttaggtagttacttacgtgttacgacgtacggggtntacggtcgtagggtactacgttagttagtgtagtaccgttcggttacgttcggtacggggtaccctaacgggg

SEQ ID NO: 343035 - DNA, 631 bp, Homo sapiens
  misc_feature: GZ8MTXP02HZO9V.4.58.F03.1.454.CMB.2.raw
tcagagcactgtagcacgaccggtgctcgatttagtctgatcgagaagggaaagggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtggtagggtttcctgcaaggcttctggatacaccttcagttagttatactatacactgggtgccgccgacggcccccggacaaacgccttgagtggatgggatcgatcaactctggcaagtggacaaacaacaaaatacttacaacagaaagttacgaggggacaggacgtacaacctacttaaccgagggaccaacactcccgacgaacacacgaccctaacagtaggagacgtagacgacacggcctaggactataccgtagaaacgaccgacggtcgtaggttaggttattacgttggtttaccggaagggtaccggggtacttaacggttcgttggggaactttacgttaaagtttaagttacggtacggttaccgttcggttaccggtttcggtacgggggaaccccgg

SEQ ID NO: 343036 - DNA, 611 bp, Homo sapiens
  misc_feature: GZ8MTXP02GA9J4.4.58.F03.1.454.CMB.2.raw
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttctggatacaccttcagttagttatactatacactggtgcgccacggcccccgganaaacgccttgagtggatgggatcgatcaactctggcaagtggacaacaacaaaatactacacagaagttacgagggtcagacgtcaacctattaccagggacacactccgacgaacacacgacctacagtggaagctaggacgcgaacgtccgtagaacctagtacgtacggaaacgaccgaacgggtccttaggtacggttaactttaccgttaggtttacggaacgggtaccgggtacgttaacgggttcgttaggggtaacttcgttaagtttaagtagttcgtaccgttcggttccgttcggtcgggggtacccg

SEQ ID NO: 343037 - DNA, 608 bp, Homo sapiens
  misc_feature: GZ8MTXP02FYGIB.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttctggatacaccttcagtagttatactatacactgggtgcgccacggcccccggacaaacgccttggagtggatgggatcggatcaactctggcaagtggcaacacaaaatacttacacagaagttacaggcagagtcaccattaccgaaggacacatccgacgaaccacacgaccctacactaggagctagacgacgacgcctacggacactaccgtaggaaacgaccgacggccttacggttgttaatttacgttgtttacggacggacggggtccttaagggttccgtagggggtaacttccgttaaggtttaagttaaggttcgtaaccgtttccggtttacgtttccggtacgggggtaaccccggg

SEQ ID NO: 343038 - DNA, 597 bp, Homo sapiens
  misc_feature: GZ8MTXP02FSH4C.4.58.F03.1.454.CMB.2.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (377)..(377): a, c, t, g, unknown or other
  misc_feature (377)..(377): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctggaggtgaagagccgtggggcctnagtgagggtttccngcaaggcttcgtggatacaccttnagttagttatactatacacgtgggtgcgccacggcccccggacaaacgccttgagtggagtgggatcgatcaactctggcaagtggacaaacaacaaaatacttacacagaagttacagggcngagtcaccattaccagggacacatccgacgaaacacacgcctacatggagctagagacagcctgaccatactagaacgacgacggcttagtaggttaacttaacgttggttacggaagggaccgggtacgttaacggtccgttagggggtaacttcgttaaagtttaagtaaggttcgtaacgttccggtttacggtttccggtacgggggtaaccccgg

SEQ ID NO: 343039 - DNA, 530 bp, Homo sapiens
  misc_feature: GZ8MTXP02HI5JB.4.58.F03.1.454.CMB.2.raw
  modified_base (291)..(291): a, c, t, g, unknown or other
  misc_feature (291)..(291): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttctggatacaccttcagtagttatactatacactgggtgcgccaggcccccgganaaacgccttgagtggatgggatcgatcaactctggcaatggacaaacacaaaatacttacaacagaagttacaggggacagagtcaccattaccgagggacacatccgacgaacacagacctacataggagctgagcagcctgacatcgagaagacacggtntgtntatcgtgtacgagacggtctagtcgtacggtactcgtagtaagtagtcgtacgtcgtcgttcggtacgggacg

SEQ ID NO: 343040 - DNA, 690 bp, Homo sapiens
  misc_feature: GZ8MTXP02I5FTF.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcgagtgagggtttcctgcaaggcttcgtggactacaccttcagttagttatactatacacgtggtgcgccacggcccccggacaaacgccttagagtggagtgggatcgatcaactcgtggacaagtcggacaaacaaactaaaatactaccaacagaaagttacagggacagacgtacaacctattaacccgaagggaaccaaccgactacccggacgaaaccaacgaacgaccctaaactacgtaggacgtacgagacgacgacgacctagaacctacgttaccgtaagaaacgaaccgtaccgggtacgttaggttacgtttaacgtttacgttacggtttaccggaacgggtaccggggtacgttaaacggttccgttagggggttaacttaccggtttaaggtttaacgtaggtttacgtaccggtttaccggtttccgggtttaccgggtttaccgggggtaaccccgg

SEQ ID NO: 343041 - DNA, 635 bp, Homo sapiens
  misc_feature: GZ8MTXP02IVWK0.4.58.F03.1.454.CMB.2.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagagcactgtagcacgaccggtgctcgatttagtctgatcgagaagggaaaggggacccaacaaccacatccctcctcagaacgccccagagcacaacgcctcaccatggactggacctggaggatcctctttttggtggcagcagccacaggtgcccattcccaggtccagcttgtgcagtctggggctggaggtgaagagccgtgggcctnagtgtagggtttccngcaaggtcttcgtggactacctaccttcagttagttatactatacacgtgggtcgcgccgacggcccccgaanaacgccttgagtggagtggatcgatcaactcgnggacaagtcggacaacaaactaaaatctacactaagaagttacgagggacaggacgtaccaaccgtaacttaaccgagggaccacactcccgacgaacacacgtaccctacacgtaggacgcgtagacgacaacggtccctagaactacgttaccgaagaaacgaccgacgggtcttaggttacgttaacgtttacgttcggttacggacggtaacgggtcgttaaggttcgtagggtacttcgtttaagttaagttacggtacgttacgttcggttccgtttcggtacgggtaaccgg

SEQ ID NO: 343042 - DNA, 562 bp, Homo sapiens
  misc_feature: GZ8MTXP02HJ44M.4.58.F03.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccacggcccccganaaacgccttgagtggatgggatcgatcaactctggcaatggacaacaacaaaatctacacagaagttacagggcagagtcaaccattaaccgagggacacatccgacgaaacacacgacctacagtaggacgcgtagacgacgacgccctagaacctatacgtagaacgacgacggctgtagttattacgtgttacggacggtacggtctaggtcgtacgggattacgtagttaagtaggtcgtacgtcgttcggttcgtacggggaccg

SEQ ID NO: 343043 - DNA, 634 bp, Homo sapiens
  misc_feature: GZ8MTXP02HKCG1.4.58.F03.1.454.CMB.2.raw
  modified_base (298)..(298): a, c, t, g, unknown or other
  misc_feature (298)..(298): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagaagccgtggggcctcgagtgagggtttcctgcaaggcttcgtggatactaccttcagtagttatactatacactgggtgcgccacggcccccganaaacgcctgagtggagtgggatcgatcaactcgtggcaatggacaaacaacaaaatactacaacagaagttacagggacagacgtacaactataccgaaggacacacgtaccgacgaacgacaacgacgtaccaacgtagaggaacgtcgagacgacgacgtacagactactacgaacgaacgaccggacggtcgttagttacgttaaacttcggttacggtacggtacgggtaacggttacggttaccggtacggggtagttaccgttaacgtttaagtttagttacggtacgttacccggtttacggtttccggttacgggggtaacccggggg

SEQ ID NO: 343044 - DNA, 550 bp, Homo sapiens
  misc_feature: GZ8MTXP02H7IAY.4.58.F03.1.454.CMB.2.raw
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
  modified_base (486)..(486): a, c, t, g, unknown or other
  misc_feature (486)..(486): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatcctcttttggtggcagcagccacaggtgcccattcccaggtccagcttgtgcagtctggggctgaggtgaagagcctgggcctcagtgaggtttcctgcaaggcttctggatacaccttcagttagttaatactatacactgggtgcgccaggcccccganaaagccttgagtgagtgggatcgatcaactctggcaatggacaacaacaaaatntacacagaagttacaggcagagtcaccattaccgagggacacatccgacgaaacacacgaccctaanatggacgcagagacacgccagtaccatcctagaaacgacgacggtctagtgtattacgtgttacgaggtaccggnttacggtcgtagggattcgttaagtaagtacgtacgacgttcggtcgtttcgacggggtacccg

SEQ ID NO: 343045 - DNA, 702 bp, Homo sapiens
  misc_feature: GZ8MTXP02GP3VI.4.58.F03.1.454.CMB.2.raw
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcgtgggcctcagtgagggtttccngcaaggcttctggatacaccttcagttagttatactatacacgtgggtcgcgccgacggcccccggaanaaacgccttagagtggagtgggatcgatcaactcgtggacaagtggacaaacaactaaaatactacaacaagaaagttacgaggggcaggacgtaccaaaccagttacccgaagggaaccacgtactcccgaacgaaaccacgaagccctaacacgtacgggaacgtcctagggacgacgtaacggcccgttaagaaccacttaccgtaaggaaaaccggtaaccgaccggggtcttaacgggttagtttaacgtttaccgttagggtttaccggaagggttaccggggtacgtttaaggggttaccggttagggggtaactttacggttaaaggtttaaggtttaacggtacggtttaacctttccgggtttacgggtttccgggtttaccggggggtaacccgg

SEQ ID NO: 343046 - DNA, 558 bp, Homo sapiens
  misc_feature: GZ8MTXP02J23AP.4.58.F03.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (416)..(416): a, c, t, g, unknown or other
  misc_feature (416)..(416): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccgganaaacgccttgagtggatgggatcgatcaactctggcaatggacaaacacaaaatacttacacagaaagttacagggcagagtacaccattacccagggacacataccgacgaacacacgaccctanatggaagctagacgcaggccagaccatccgtagaaacgacgaacggctgtacgtattaacgtgttacgaggtacggctacgttcgtagggactacgttaagttaataggtacgtactcggttcgttaccggtcgggacccgg

SEQ ID NO: 343047 - DNA, 524 bp, Homo sapiens
  misc_feature: GZ8MTXP02GBGQ3.4.58.F03.1.454.CMB.2.raw
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccacggcccccgganaaagccttgagtggatgggatcgatcaactctggcaatggacaacaacaaaatatacacagaagttacaggcagagtcacataccaggacacatcgacgaacacagcctacataggagctagagcagcctagacatctagaagacacggctgtagtattactgttacgagacgggtactagtcgtagggactgtagttaatagtacgtacgtcgtcgtcgtcggggtaccg

SEQ ID NO: 343048 - DNA, 602 bp, Homo sapiens
  misc_feature: GZ8MTXP02JX2O3.4.58.F03.1.454.CMB.2.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccgaggcccccgganaaacgccttgagtggatgggatcgatcaactctggcaatggacaaacactaaaatacttacaacagtaagttacgagggtcagacgtacaacctaattacccgaagggaccacactcccgacgaacacgagccctacagtggagctgacgcacgcctagacatacgtagaaacgacacggtctaggtgttaactttacgtacggtttacgaagggtacgggtccgttaaggttcgtacggggatttacgttaaggtttaacgtaggttacgtacgttccggttacggtttccggtacgggggtaacccgg

SEQ ID NO: 343049 - DNA, 657 bp, Homo sapiens
  misc_feature: GZ8MTXP02JF7YX.4.58.F03.1.454.CMB.2.raw
  modified_base (299)..(299): a, c, t, g, unknown or other
  misc_feature (299)..(299): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagccgtggggcctcagtgagggtttcctgcaaggcttcgtggatacaccttcagtagttatactatacacgtgggtcgcgccgacggcccccgganaaacgccttggagtggagtgggatcgatacaactcgtggcaagtggacaaacaacaaaatacttacaacgaagtaagttaccgaggggactagacgtaccaaccgtaacgttaaccgaaggggaaccaacgaacgtacccgaaccgaaaccaccgaacgacccttaaacgacgtacgggaacgtaccgtagaacgaccgaacgacccgtacgaacctacgtaccgtagaaacgacgaacgggtcgtagtagttaacttacgtggtttacggacgggtacgggtctaggtcgtagggtaacttcgtaaggttaagtacggtacggtacgttcggttccggtttcgtcgggggtaacccg

SEQ ID NO: 343050 - DNA, 674 bp, Homo sapiens
  misc_feature: GZ8MTXP02IYHKT.4.58.F03.1.454.CMB.2.raw
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagagccgtggggcctcagtgtagggtttcctgcaaggcttcgtggatacnccttcagttagttatactatacactgggtncgccacggcccccganaaacgccttaggagtggagtgggatacgatacaacgttctagggactaagtcggacaaaacaactaaaaattcccttacaacgtaagtaaacgttacgaacggggacaggactaccaaaccgtaacttaacccgaagggaaccaacactacccgaaccgaaaccaaccgaacgtaccctaacgaacgtcgggaacgtcgtacgagacgaaaccggtcctaaggacctaacgttcgtaaaggaaaaccgaccgtaacgggtaccgttaggttagttaacttaccgttggtttacggacgggtaacggtcgttaaaggtcggttacgggattcgttaagtaagttgtacgtacgttcggtcgttcggacgggtacccgg

SEQ ID NO: 343051 - DNA, 616 bp, Homo sapiens
  misc_feature: GZ8MTXP02GSZIP.4.58.F03.1.454.CMB.2.raw
  modified_base (296)..(296): a, c, t, g, unknown or other
  misc_feature (296)..(296): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagccgtggggcctcagtgagggtttcctgcgaaggcttcgtggatacaccttcagttagttatactatacactgggtgcgccacggcccccgganaaacgccttgagtggatgggatcgatcaactcgtggcaatggacaaacaactaaaatacttacaactaagaaagttacgagggacaggacgtaccaacctaattaccgaaggggacctacaacgtcccgaacgaaaccaacaacgccctaacagtacgggaacgcctaggacgacgaagaccccgtaggaacctaactacgtacgaaacggaccgaacgggtctaggttagttaactttacgtcggttacggaggtacgggtctaggtcgtagggacttcgttagtaagtagtcgtactggtcgttcgtcggggtaaccg

SEQ ID NO: 343052 - DNA, 525 bp, Homo sapiens
  misc_feature: GZ8MTXP02F88I5.4.58.F03.1.454.CMB.2.raw
  modified_base (292)..(292): a, c, t, g, unknown or other
  misc_feature (292)..(292): n is a, c, g, or t
  modified_base (417)..(417): a, c, t, g, unknown or other
  misc_feature (417)..(417): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagccgtggggcctcagtgagggtttcctgcaaggcttctggatacaccttcagtagttatactatacactgggtgcgccaggcccccgganaaagccttgagtggatgggatcgatcaactctgggcaagtggacaacacaaaatactacacagaagttacaggcagagtcaccataccagggacacatccgacgaacacagccctacactggaanctagagcagcctgacatcagaacgacacggctgtgtatacgtgttacgagacggctagtctggggtactcttagttaatagtgacttcgtacgttcgtggggtacccg

SEQ ID NO: 343053 - DNA, 589 bp, Homo sapiens
  misc_feature: GZ8MTXP02H13D3.4.58.F03.1.454.CMB.2.raw
  modified_base (304)..(304): a, c, t, g, unknown or other
  misc_feature (304)..(304): n is a, c, g, or t
  modified_base (439)..(439): a, c, t, g, unknown or other
  misc_feature (439)..(439): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtcgtggggctgaggtgaagaagccgtggggcctcgaggtggtagggtttcctgcgaaggtcttcgtggatactaccttcagttagttatactatacagtgggtgcgccgacggcccccgganaaacgccttagagtggatgggatcggatcaactcgtggactaagtggacaaacaacaaaatactacacaagaagttacaggggacagagtacactattaccgagggacacactaccgacgaacacacgaccctanatggaacgctgagcagcctgacatcgagaagacgacggtctgtagtattacgtagtttcgaacggtcgggacttaaggtcgtaggggtacttacgttaaggttaagtaggtacgtaccgttcggttccggttacggttcggggaacccgg

SEQ ID NO: 343054 - DNA, 583 bp, Homo sapiens
  misc_feature: GZ8MTXP02HVBR1.4.58.F03.1.454.CMB.2.raw
  modified_base (228)..(228): a, c, t, g, unknown or other
  misc_feature (228)..(228): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtcgtggggctgaggtgaagaagcctgggcctcagtgagggtttccngcaaggcttctggatacaccttcagttagttatactatacactgggtgcgccgacggcccccggaacaaacgccttaggaggtggagttgggatcggatacaactcgtggactaatggacaaacaacaaaatacttacaacagtaaacgttacgagggcagagtcacctataaccgaggacacactccgacgaacacacgcctacactgagcagacgcagtcctagaccatctagaacgacgacggcgtagtagtattacgtgttacgaagggttaccggacttaggcgttacgggattacgttaagttaagtaggtacgtacgttccgttacggttcggtacggggtaccccgg

SEQ ID NO: 343055 - DNA, 563 bp, Homo sapiens
  misc_feature: GZ8MTXP02GES8S.4.58.F03.1.454.CMB.2.raw
  modified_base (292)..(292): a, c, t, g, unknown or other
  misc_feature (292)..(292): n is a, c, g, or t
  modified_base (416)..(416): a, c, t, g, unknown or other
  misc_feature (416)..(416): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccgganaaagccttgagtggatgggatcgatcaactctaggcaagtggacaacaacaaaatacttacacagaaagttacagggcagacgtcaccattaccagggacacatccgacgaacacagaccctanatggagctagagcagcctgaccatactagaacgacgacggcttagtagttaacttacgtgttacgaggacgggtactagtcgttagggacttcgttaaggttaataggtacgtacgttccggtacggtttacgtcggggtaacccgg

SEQ ID NO: 343056 - DNA, 637 bp, Homo sapiens
  misc_feature: GZ8MTXP02I45YA.4.58.F03.1.454.CMB.2.raw
  modified_base (212)..(212): a, c, t, g, unknown or other
  misc_feature (212)..(212): n is a, c, g, or t
  modified_base (338)..(338): a, c, t, g, unknown or other
  misc_feature (338)..(338): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagagcctgggcctnagtgagggtttcctgcaaggcttctggatacaccttcagtagttatactatacactgggtgcgccacggcccccgacaaacgccttgagtggatgggatcgatcaactctggcaatggacaacaanaaaatacttacaacagaagttacaggggacaggacgtacaacctattaccgaagggaccacacgtacccgacgaaacacaacgccctaacataggagacctagaacgaccaacggccctagaactactacgtacgaaacggaccacgggtacttaggttcgttaactttacgtcggtttaaccggaacgggtaccggggtaccgttaaggttccggttaggggtaactttaccggtttaaagtttaagttacggttacgtaaccgtttcggttccggtttacggtacgggggtaccccg

SEQ ID NO: 343057 - DNA, 595 bp, Homo sapiens
  misc_feature: GZ8MTXP02JNB3Q.4.58.F03.1.454.CMB.2.raw
  modified_base (238)..(238): a, c, t, g, unknown or other
  misc_feature (238)..(238): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttcnggatacaccttcagtagttatactatacactgggtncgccaggcccccgganaaagccttgagtgatgggatcgatcaactctggcaatggacaacacaaaatacttacacagaagttacagggacagagtacaccattacccgaggacacaactccgacgaaacacganaccctaanagtagacgcgagacgacgacgccagactagtacgtaagaacgacgacggtcgttaggttagttaacttacgtacgttacggacggtacgggtacgttacggtacggtacgggtacgttacgttaaggttaagtacggtacgtaccgttccggtttaccggttacggtacggggtacccg

SEQ ID NO: 343058 - DNA, 638 bp, Homo sapiens
  misc_feature: GZ8MTXP02HWK5Z.4.58.F03.1.454.CMB.2.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatcctctttttggtggcagcagccacaggtgcccattcccaggtccagcttgtgcagtctggggctggaggtgaagaagcctggggcctnagtgagggtttccngcaaggcttctggatacacttcagtagttatactatacactgggtncgccgacggcccccganaaacgccttagagtggagtggatcgatcaactcgtggactaagtcggactaaacgaactaaaattacttacaatacggaaagttacgaggggacaggaacgttacaacctaacttaaccgaagggaacaacgactacccgacgaaaccacgacgaaccctacacgtaggacgacgtagacgacgacggtaccctacggaacacttacgaacgaaacggaccgaacggtacgttaggttagttaactttacgtggtttacgaggttaccggtactagggttctagggtacttcgttaagtaagttacgtacgtacgttcgttacggttcggtacggggtacccgg

SEQ ID NO: 343059 - DNA, 586 bp, Homo sapiens
  misc_feature: GZ8MTXP02IU1DM.4.58.F03.1.454.CMB.2.raw
  modified_base (276)..(276): a, c, t, g, unknown or other
  misc_feature (276)..(276): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccaggcccccggacaaagcccttgagtggatgggatcgatcaactcnggcaatggcaacacaaaatntacacagaagttacagggcagacgtcaccattaccgagggacacactccgacgaacaacacgccctaacagtaggagctagagcagcctagacatcgtagaacgacgaacggtctaggtgttaagtacgttggttacgagggtaaccgggtcgttaaacggtccgttagggggtaaacttcgttaaggttaagtacggttacggtaccttcggtttccggtttacgtcgggggtaacccgg

SEQ ID NO: 343060 - DNA, 641 bp, Homo sapiens
  misc_feature: GZ8MTXP02IT0PC.4.58.F03.1.454.CMB.2.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagagccgtgggcctnagtgaggtttccngcaggcttntggatacaccttnagttagttatactatacacgtgggtgccgccgacggcccccgaanaaacgccttagagtggagtgggatcgatcaactcgtggacaagtcggaacaaacaactaaaaatcttacaacaagtaaagttacgagggacaggtacgtaccaaaccgtattaacccgagggaacctaacgactaccgaccaaacaccgacgaccctacagtcggacgtacgagacgaccacggtccttaacggacctagttaccgaagaaacgacgaaccggtcgttagttacgttacgttaacgttcggttacggacggtacgggtcgtaaaggtcggttacggtattacgttaagttaagttacgtacgttacgtcggttcgttcggtacgggtaacccgg

SEQ ID NO: 343061 - DNA, 651 bp, Homo sapiens
  misc_feature: GZ8MTXP02GB8VI.4.58.F03.1.454.CMB.2.raw
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtgagggtttcctgcaaggtcttcgtggatacaccttcagtagttatactatacactgggtncgccacggccccganaaacgccttgagtggatgggatcgatcaactcgtggcaagtcggacaaacaacaaaatacttacaacaagtaacgttaacgaggacagacgtacaaccgtaattacccgaaggggtaccaacgtacgtacccgaaccgaaaccaaccgacggaccctaacacgtacgggaacgcctagggacgacgaacggcccgttagggtaccaagttcgtagaaacggtaccgaaccgggtcgttaggttagtaacgtttacgtcggtttacggaaggtaccgggtacgttaggttacggtaggtacttacgtagtttaagtaggtacgtacgttcggttcgttaccggtcggggtaaccccgg

SEQ ID NO: 343062 - DNA, 684 bp, Homo sapiens
  misc_feature: GZ8MTXP02H0GCB.4.58.F03.1.454.CMB.2.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagagcactgtagcacgaccggtgctcgatttagtctgatcgagaagggaaaggggacccaacaaccacatcccctcctcagaagccccagagcacaacgcctcaccatggactggacctggaggatccttctttttggtggcagcagccacaggtgcccattcccaggtccagcttgtgcagtctggggctggaggtgaagagccgtggggcctgagtgtagggtttccngcaaggtcttcnggatcaccttnagtagttatactatacacgtggtgcgccgacggcccccgganaaacgccgttagaggtggagtgggatcgatcaactcgngacatggacaaacacaaaatctacacagtaagttacgaggacaggactacaaccacgttaaccgaggaacacactccgacgaacacgacgacctaacagtaggacgacgtagacgacacgtacctagactacgtacgtagaacgacggtaacggtcttaggttacgtttaacgtttaacgtttcgggtttaaccgggacgggtttaaaccgggggtacgttttaaacggggtcccggtttacgggggtaccgttttacgtttaaaggtttaaggtttacggtttaaccggtttaccggtttacccgggttttccgggttttaccgggtttacccgggggtaaccccggg

SEQ ID NO: 343063 - DNA, 600 bp, Homo sapiens
  misc_feature: GZ8MTXP02GM0NW.4.58.F03.1.454.CMB.2.raw
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttcctgcaaggcttctggatacaccttcagttagttatactatacactgggtgcgccacggcccccgganaaagccttgagtggatgggatcgatcaactctggcaagtggacaaacacaaaatacttacaacagaagttacgagggacagagtcaccattaccagggacacatccgacgaacacgagccctaacataggacgcgtagagacacggccctggaactatccgtaggaacgacgacggcttggtagtagtttaacgtggtttacggacggtacggggtaccttaaggtccgtaggggtaacttacggtttaagttaagttaggttacggtaacgtttccggttcggtttcggttacgggggtaacccgg

SEQ ID NO: 343064 - DNA, 675 bp, Homo sapiens
  misc_feature: GZ8MTXP02GVFVT.4.58.F03.1.454.CMB.2.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtncgccacggcccccganaaacgccttgagtggatgggatcgatcaactctggcaagtggacaacaactaaaatacttacaacaagtaaacgttacgaggggacaggaacgttaccaaaccctaagtttaacccgaacggggtaaccaaacgaacgttacccggaaccggaaaaccaaccgaacggaaccccttaacgaacgttacgggaacgccgtaggaacgaccaacgcccgttagaacctatacgtaacgaaacgaaccgacgggtctagggttattaacgtttacgttacggtttacggacggtaccggggtcttaaacggtccgttaggggtaacttgttaaggttaagttagtcgtaacgttcggttcggtttcggtacgggggtaaccccgg

SEQ ID NO: 343065 - DNA, 625 bp, Homo sapiens
  misc_feature: GZ8MTXP02HKBUO.4.58.F03.1.454.CMB.2.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtgagggtttcctgcaaggcttctggatacaccttcagttagttatactatacactgggtgcgccacggcccccgganaaacgccttgagtggagtgggatcgatcaactcnggcaagtggacaaacaacaaaatacttaccaacagtaagttacagggcagngtacacataccagggacacactccgacgaacacgacgccctaacagtaggagaccgtagagacagcccttaggacctataccgtagaacgaccgacggcttggttagttacgtttaacgttcgggtttaacgacgggtacggggtccttaagggttccgttaggggtactttacgttaaggtttaacgttagggttacgtaaccggtttcggttaccggtttccgggtacgggggtaacccccgg

SEQ ID NO: 343066 - DNA, 566 bp, Homo sapiens
  misc_feature: GZ8MTXP02FKAGE.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctgggcctcagtgagggtttcctgcaaggcttctggatacaccttcagttagttatactatacactgggtgcgccacggcccccggacaaagccttgagtggatgggatcgatcaactctggcaagtggacaaacaactaaaatacttacaacaagaagttacagggcagagtcacataccagggacacatccgacgaacacagcctacactggaagctagagaccgagcctagacatactagaacgacaccggtctagtgtaattacgtgttacggagtacgggtactaggttcgtaggggtactcggttaagttaagttaggtacgtacgtcggttcgtttacggcggggtaacccgg

SEQ ID NO: 343067 - DNA, 619 bp, Homo sapiens
  misc_feature: GZ8MTXP02IAAYK.4.58.F03.1.454.CMB.2.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctcttttggtggcagcagccacaggtgcccattcccaggtccagcttgtgcagtcgtggggctgaggtgaagagctgggcctnagtgaggttccngcaaggcttnggatacaccttnagttagttatactatacactgggtgcgccacggcccccggaanaaagccttggagtggagtgggatcgatcaactctggcaatggacaacaacaaaatctacaacagaagttacaggggtcagagtcaccattaaccgaggacacacgtccgacgaacacacgcctaacagtcggaagcgtagacgacgacggcctaggactattaccgaaggaaacggaaccgacggtacgtggttagttaacgtttaaacgtcggtttacggaacgggtacggggtacgttacggttaccgtagggggtacttacgttaaaggtttaagtcggttacggtacgtttaccggtttcgggttacgtttccgggggtaaccccgg

SEQ ID NO: 343068 - DNA, 643 bp, Homo sapiens
  misc_feature: GZ8MTXP02H4XN1.4.58.F03.1.454.CMB.2.raw
  modified_base (231)..(231): a, c, t, g, unknown or other
  misc_feature (231)..(231): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (462)..(462): a, c, t, g, unknown or other
  misc_feature (462)..(462): n is a, c, g, or t
tcagagcactgtagcacgaccggtgctcgatttagtctgatcgagaagggaaaggggacccaacaaccacatcccctcctcagaagccccagagcacaacgcctcaccatggactggacctggaggatccttctttttggtggcagcagccacaggtgcccattcccaggtccagcttgtgcagtctggggctggaggtgaagaagcctggggcctcagtgagggtttccngcaaggcttcgtggatacaccttcagtagttatactatacactgggtncgccacggcccccgaanaaacgccttgagtggatgggatcgatcaactcgtggctaagtggacaaacgaactaaaaattcttaccaaactaagtaaagtttacgaggggactaggacgttacaacctattaacccgaagggactacgactacccgacaacacaacgcctaacagtggacgtcngagcgaagccctagactacgtgtaacggaacgaccgacggtctaggttagttacgttacttacgggttacggaacggttacggggtacttacggtacgtaggggtaccttagtttaacggtttaacgtaggttacgttaccggtttcggttaccggtttcggggtaccggggtaacccggg

SEQ ID NO: 343069 - DNA, 707 bp, Homo sapiens
  misc_feature: GZ8MTXP02JJN30.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctcagtgagggtttcctgcaaggcttctggatacaccttcagtagttatactatacacgtgggtgcgccgacggcccccggacaaacgcctgagtggagtgggatcgatcaactcgtggacaatggacaacaacaaaatacttacacaagaaagttacaggggtacaggacgtacaaccgtaattacccgaaggggtaccaaacgactacccgaccgaaaccaccaacggaccctaacgacgtacggacgtacgtacggaacgaccgaaacgcccgtacggtaaccaacgtttacccggtaaggaaaaccggaccgaaacggggttccgttacgggttaagtttaacgtttaaacgttcgggtttaaccgggaacggggttacccgggggtaccggttaaaggttccggttacgggggtaacttaccggttaagtttaacgtaggttacggtaccgtttccgggtttaccggtttcgggtacgggggtaaccccggg

SEQ ID NO: 343070 - DNA, 528 bp, Homo sapiens
  misc_feature: GZ8MTXP02FH74A.4.58.F03.1.454.CMB.2.raw
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctcttttggtggcagcagccacaggtgcccattcccaggtccagcttgtgcagtctggggctgaggtgaagaagcctggggcctcagtgagggtttccngcaaggcttctggatacaccttcagttagttatactatacactgggtgcgccaggcccccgganaaacgccttgagtggatgggatcgatcaactctggcaatggacaacacaaaatattcacagaagttacagggcagagtcacattaccagggacacactccgacgaaacacagcctacatgganctgagcagtccngaccatcngaacgacacggctgtgtattacgtgttacgagacgggtctagtcgtgggaactcgttagtaagtagtacgacgtcgtcgttcgcgggtaccgg

SEQ ID NO: 343071 - DNA, 703 bp, Homo sapiens
  misc_feature: GZ8MTXP02IZTJD.4.58.F03.1.454.CMB.2.raw
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagagcctgggcctnagtgagggtttcctgcaaggcttcgtggatacaccttcagttagttatactatacacgtgggtgcgccacggcccccggaanaacgccttagagtggagtggatcgatcaactcgtggacaagtcggacaaacaaactaaaatactacaactagtaaagttacgaggggacaggactcaacctagttaccgaagggtacaacacgtacccgacgaaacacacgaccctacgacgtaggacgccgtaggacgaccaacggtacccgtagtaaccgtacttaccgtaaacggaaacgaaccgtaaccggggtccttaggtttaacggtttaaacgttttaacggttcgggtttaacggaacggggttaacccggggttacgttaacggttacggttaggggtaaccgtttaacgtttaaacggtttaagttaacggttacgttaccggtttaccggttccggtttacgggtttaccgggggtaaccccgg

SEQ ID NO: 343072 - DNA, 677 bp, Homo sapiens
  misc_feature: GZ8MTXP02GM3FC.4.58.F03.1.454.CMB.2.raw
  modified_base (229)..(229): a, c, t, g, unknown or other
  misc_feature (229)..(229): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagcctggggcctcagtgaggtttccngcaaggtcttctggatacaccttcagttagttatactatacacgtgggtcgcgccgacggccccccggaacaaacgccttaggagtggagtgggatcgatcaactcgtggcaagtggacaaacaacaaaatactacaacaagtaaagttacgagggacaggacgtacctaaccaacgttaacccgaacggggtaaccaactacgtacccgaccgaaaccaacgacgaccctaacacgtacggaacgcctagaacgaccgaacgacccgtagaaccagttacgacgaaaacgaccgtacgggtaccgttaggttacgttacgtttacgttacggtttacggaacggtacggggtacttaaacgggttcggttacggggtactttagttaagtttaagtacggttacgtaccgtttcggttaccggtttcgggtaccgggggtaacccgg

SEQ ID NO: 343073 - DNA, 644 bp, Homo sapiens
  misc_feature: GZ8MTXP02GA0EJ.4.58.F03.1.454.CMB.2.raw
  modified_base (234)..(234): a, c, t, g, unknown or other
  misc_feature (234)..(234): n is a, c, g, or t
  modified_base (339)..(339): a, c, t, g, unknown or other
  misc_feature (339)..(339): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagagccgtgggcctcagtggtacgggttttccngcaaggtcttcgtggataccaccttcagttagttatactatacacgtgggtcgcgccacggcccccggaacaaacgccttgagtggagtgggatcgatcaactcngacaagtgacaacaacaaatatacacagaagttacgaggacagacgtacaactacttaccgaagggacacactccgaccgaacacgacgaccctacagtaggacgactagacgacgacgtccgagactagtacgtagaaacgacgtacggtactggttacgttattaacggttcggtttacggacgggtaccgggtaccgttaagggtccgttggggtaactttacggtttaaacggtttaacgttaaggtttacgtaacggtttccgggttaccgggtttacgggttacgggggttaaccccgg

SEQ ID NO: 343074 - DNA, 619 bp, Homo sapiens
  misc_feature: GZ8MTXP02IJHO9.4.58.F03.1.454.CMB.2.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagagcgtgggcctnagtgaggttcngcagcttgngatacncttnagtagttatactatacacgtgggtncgccgacggaccccganaacgccgttgagtggagtggatcggatcgaacgtctaggactaagtggaacaaacaaactaaaatacctacaacgtaagtaacgtaacgagggacaggtacgtacaacctaacgttaaccgagggaacaccgatacccgacaaacacaacgaccctaacgagtaggagcgtagacgaccgacggccctagaactagtacgtagaacgaccgtacggtcgttaggttacgttagttacgttaggttacggaaggtaccgggtacttaggtaccgtaggtacttacgttagttaagtacgtacgtacgtacggttcgtttacggcgggtacccg

SEQ ID NO: 343075 - DNA, 620 bp, Homo sapiens
  misc_feature: GZ8MTXP02HPXH9.4.58.F03.1.454.CMB.2.raw
  modified_base (230)..(230): a, c, t, g, unknown or other
  misc_feature (230)..(230): n is a, c, g, or t
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcgagtgagggtttccngcaaggcttcgtggatacaccttcagtagttatactatacacgtgggtgcgccaggccccccganaaacgccttgaggtggagtgggatcgatcaactctggcaatcggacaaacaanaaaactattacaacaagtaaacgtttacgagggacaggtacgtacaacctaatttaacccgaaggggaacaccaacgtcccgaccgaaacaaccacgccctaaacagtcggaacgtcgtagacgcgaacgtcctacggaactcgtactagaaacgacgacggtctggtataagtttacgtcgttacggtagaccgggtacgtaggttcggtagggtactttacgtagttaagtaggtacgttactcggttcgtttcggtcggggtaacccgg

SEQ ID NO: 343076 - DNA, 619 bp, Homo sapiens
  misc_feature: GZ8MTXP02JROTZ.4.58.F03.1.454.CMB.2.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (450)..(450): a, c, t, g, unknown or other
  misc_feature (450)..(450): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagtctggggcctcagtgagggtttccngcaaggcttcgtggatacaccttcagtagttatactatacactgggtncgccgaggcccccgaanaaacgccttagagtggagtgggatcgatcaactctaggcaagtggacaacaacaaaatactacaactagaagttacgagggacagacgtacaacccgtattaaccgagggacaaccgaactcccgaacgaaccacgacgaccctaacagtcggaancctaggaacgacaacggtccctaggacctattccgagaaacgaccgaacgggtcttaggttacgttaagtttaccgtggtttaccgagggtaccggtataccggtggtacgggacttacgtagtttaagtaggtacgtacgttcggttacggttcggtcggggtaaccg

SEQ ID NO: 343077 - DNA, 641 bp, Homo sapiens
  misc_feature: GZ8MTXP02JXZNE.4.58.F03.1.454.CMB.2.raw
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttcgtggatacaccttcagtagttatactatacactgggtgcgccacggcccccgganaaacgccttgagtggatgggatcgatcaactcgtggacaagtggacaaacaacaaaatacttacacagaacgttacaggcagagtcaacatacagggacacatccgacgaacacacgaccctacagtacggagcgtaggacgacgacggacccttcggaaccctagttaccgtaacggaaaacggacccgtaacggggtaccttagggttacgttaagtttaccgttacggtttacgggaacggtaccggggtacttaacgggtccgttaggggtacttacgtttaaggttaacgttaggttacggtacgtttcggtttccggtttacggttacgggggtaacccgg

SEQ ID NO: 343078 - DNA, 661 bp, Homo sapiens
  misc_feature: GZ8MTXP02FQJ9O.4.58.F03.1.454.CMB.2.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtncgccaggcccccgganaaagccttgagtggatgggatcgatcaactctggcaatggacaaacaacaaaatctacaacaagaagttacgaggggacagacgtacaacctaattaacccgaaggggaaccaacgaacttcccgaacggaaaaccaacaacgacccttaaacacgttaggaacgcctagacggacctaaggccccttaggaacatacgtagaaacgaccgaacggtcttaggtacgttaactttacgttacgggtttacgaacgggtaccggggtacttaaacgggttcgttagggggtaacttacgtttaaaggtttaagtaacggttaggtaacccgtttcgggtttccgtttacgggttcgggggtaaccccgg

SEQ ID NO: 343079 - DNA, 608 bp, Homo sapiens
  misc_feature: GZ8MTXP02J1AT2.4.58.F03.1.454.CMB.2.raw
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttctggatacaccttcagttagttatactatacactgggtgcgccacggcccccgganaaacgccttagagtggatgggatcgatcaactcgtggacaagtggaccaaacaaactaaaaatcttacaacgtaagaaaacgttacgaaggggtcaggagtacaacctagttaaccgaagggaccacaacgtacccgacgaaaccaacacgaccctaacacgtacggagcctagaacgcgaacgtcccgtagacctataccgtagaaacgacgacggacttgtagttattacgtgttcgaggacgggtctaggtcgtaggacttcgttaagttaagtacgttacgtacgttacgtcggttcgtacggggtacccg

SEQ ID NO: 343080 - DNA, 587 bp, Homo sapiens
  misc_feature: GZ8MTXP02FT3NC.4.58.F03.1.454.CMB.2.raw
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (452)..(452): a, c, t, g, unknown or other
  misc_feature (452)..(452): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagccgtgggcctcagtgagggtttcctgcaaggcttctggatacaccttcagtagttatactatacactgggtncgccgacggcccccggaanaaacgccttggagtggagtgggatcgatcaactcgtggcaagtcggacaaacaaacaaaatacttacaactaagaacgttaacaggggacaggactcaaccgtacttacccgaaggaccacacgtcccgacgaaacacacgaccctacagtaggancgtagacgacagacatagactatacagaacgacacggtctgtagtagttaactcggttacgagggtaccggtacttaggtcgtagggtattacgtaagttagtagtacgtacgttcgttcggttacggtacgggg

SEQ ID NO: 343081 - DNA, 663 bp, Homo sapiens
  misc_feature: GZ8MTXP02JQ984.4.58.F03.1.454.CMB.2.raw
  modified_base (297)..(297): a, c, t, g, unknown or other
  misc_feature (297)..(297): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggtcttcgtggatacaccttcagttagttatactatacactgggtgcgccgacggcccccgganaaacgccttgagtggagtgggatcgatcaactcgtaggcaatggacaaacgaacaaaatactacaacaagtaaacgttacgagggtacagagtaccaaccctagttaacccgagggaccacaacgtacccgacgaaacacgacgacccgtaacgagtaggacgtacgtacgacgacacggaccgtacgactactcgtaacgaaacgaaccgacggtacgtaggttacgttaaacgtttacgtacgtttaccgggaggtaaccgggggtacttaacggtaccggttaggggtaactttaccgttaagtttaacgtacggttacgttacgttccggttacggtttccgggtacggggtaacccccggg

SEQ ID NO: 343082 - DNA, 627 bp, Homo sapiens
  misc_feature: GZ8MTXP02FZRV8.4.58.F03.1.454.CMB.2.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctnagtgagggtttcctgcaaggcttctggatacaccttnagtagttatactatacactgggtgcgccacggcccccgganaaagccttgagtggatgggatcgatcaactctggacaagtcggacaacaacaaaatactacacaagtaaagttacgagggacagacgtaccaacctaacttaacccgaagggaccaacgactacccgaaccgaaacaacgaacgaccctaacagtacgggaacgcgtagacgaccgacgccctagactactacgtaagaaacgaccgaacggcgttagtagttaactttacgtcggtttacggacgggtacgggtacttaacggtcgtaggggtaactcgtttaaggttaagttaagtcgtacgttcggttacggttcggtacggggtacccgg

SEQ ID NO: 343083 - DNA, 540 bp, Homo sapiens
  misc_feature: GZ8MTXP02JCU0T.4.58.F03.1.454.CMB.2.raw
  modified_base (132)..(132): a, c, t, g, unknown or other
  misc_feature (132)..(132): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctntttttggtggcagcagccacaggtgcccattcccaggtccagcttgtgcagtctggggctggaggtgaagagcctgggcctnagtgagggtttccngcaaggcttcnggatacacttnagtattatactatacactgggtncgccaggcccccganaaagccttgagtggatgggatcgatcaactctgggcaatggacaaacgacaaaatacttcaacagtaagttacgagggcaggagtcaccattaccgagggacacatccgacgaacacagcctacatggagctgagcagcctgacntacgagaagacacgggctgtagttagtactggttaccggaggtaccgggtntaggtcgtagggattcgtaagttaagtagtcgacttcgtcgttcgcggggtacccg

SEQ ID NO: 343084 - DNA, 601 bp, Homo sapiens
  misc_feature: GZ8MTXP02JO0F5.4.58.F03.1.454.CMB.2.raw
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
  modified_base (379)..(379): a, c, t, g, unknown or other
  misc_feature (379)..(379): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagccgtggggcctcagtgagggtttcctgcaaggcttntggatacaccttcagttagttatactatacactgggtgcgccacggcccccgaanaacgccttgagtgagtgggatcgatcaacgtcgtaggcaagtggacctaaacaaactaaaatacttacaacagtaaacgttanagggacagagtccaaccattaccgaggaccacgactcccgacgaacacgacgaccctacgagtacggacgcgtacgagaccgacgtcccgtagacctatacgtacgaaacgacgacggttctaggtagttacgttaacgtggttacgacggtacgggacgtacgtcggttaggacttagtagttaagtagtacgtacgttcgtcgtttcggcgggtacccgg

SEQ ID NO: 343085 - DNA, 551 bp, Homo sapiens
  misc_feature: GZ8MTXP02FMTB9.4.58.F03.1.454.CMB.2.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagttatactatacactgggtncgccaggcccccgganaaagccttgagtggatgggatcgatcaattctggcaatggcaaacacaaaaatacttacacaagaagttacagggcagagtcaacattaaccagggacacatcccgacgaacacagccctacataggagctagagcagcctgacatctagaacgacacggctgtagtacttacgtgttacgaggacgggtactaaggtcgtaggggtactcgttaagttaagtagttcgacgttcggttcgttcggtcggggaacccg

SEQ ID NO: 343086 - DNA, 633 bp, Homo sapiens
  misc_feature: GZ8MTXP02JY8EL.4.58.F03.1.454.CMB.2.raw
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtgagggtttcctgcaaggcttcgtggatacaccttcagttagttatactatacactgggtgcgccacggcccccgganaaacgccttgagtgagtgggatcgatcaactctggcaatggcaaacacaaaaatacttacaanagtaaacgttacgaggggcagacgtacaccgtaattaaccgaggggacacaacgtacccgacgaaacaccacgaccctacgaagtcggaanccgtagacgcgaacggcctacggaccagtccgtagaacgacgaacggtcgttaggtcggttaatttacgttcggttacgacgggtacggggtcttaaggttccgtggggtaacttaccgttaaggtttaacgttaggttacggtaacgttccggttcggtttacggtacggggtaaccccggg

SEQ ID NO: 343087 - DNA, 592 bp, Homo sapiens
  misc_feature: GZ8MTXP02H84B2.4.58.F03.1.454.CMB.2.raw
  modified_base (306)..(306): a, c, t, g, unknown or other
  misc_feature (306)..(306): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtcgtggggctgaggtgaagaagccgtggggcctcgagtggtagggtttcctgacgaaggtcttcgtggatactaccttcagttagttatactatacacgtgggtcgcgccgacggcccccgganaaacgccttgagtggagtgggatcgatcaactcgtggacaagtggacaaacaacaaaatactacaacagaagttacgagggcagacgtacacctactaccgaggacacactccgacgacacacgcctacagtggacgcgtgacgacgacgacctgactatacgagaacgaccgacggtcgtggttattacgtttacgtggttacggacggtacgggtactaggttcgtacgggtattacgttagttaagtacgtcgtacgtcggttacgtcggttacgggacccgg

SEQ ID NO: 343088 - DNA, 658 bp, Homo sapiens
  misc_feature: GZ8MTXP02IQ6P8.4.58.F03.1.454.CMB.2.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (571)..(571): a, c, t, g, unknown or other
  misc_feature (571)..(571): n is a, c, g, or t
tcagagcactgtagcacgaccggtgctcgatttagtctgatcgagaagggaaagggacccaacaaccacatccctcctcagaacgcccccagagcacaacgcctcaccatggactggacctggaggatccttcttttggtggcagcagccacaggtgcccattcccaggtccagcttgtgcagtcgtggggctgaggtgaagagccgtggggcctnagtgagggtttcctgcaaggcttctggatacaccttcagttagttatactatacactggtgccgcacggcccccgaanaaacgccttgagtggatcgggatcgagtcaaactctagggcaagtggaccaaactaactaaaaatacttaccaaacgaagtaaagttaaccgaggggaccagagtccaaacccgtaattaacccgagggaaccagaactacccgacgaaacacgaacgccctaaaccgagaggaacgcctagaacgcgaacggtaccctggaacaacctcttaagaaacggaccaaacgggtccttacggtagtaatttacgtcggtttaccggaggtacccggggnttaaaccgggtcgtagggggaacgtttacctaaggtttaagtaggtagtaaccgttcggttcggtttccgttagggggaaccccggg

SEQ ID NO: 343089 - DNA, 661 bp, Homo sapiens
  misc_feature: GZ8MTXP02IT7J1.4.58.F03.1.454.CMB.2.raw
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctnagtgagggtttccngcaaggcttctggatacaccttcagttagttatactatacactgggtncgccacggcccccganaaagccttgagtggagtgggatcgatcaactcgtggacaagtggacaaacaactaaaaattacttaccaactaagtaaacgttacgaggggtacaggacgtaccaacctaacttacccgaagggaaccacgactccgacgaacacacgaccctaacagtacggacgcgtagacgacgacgtccgtacggactacgtacgtaacgaaacgaccgtaacgggtcgttacggttagttaacgtttacgtaggtttaccggaacgggtaccggggtacttaacggttaccggttaggggttaacttacgtttaaggtttaagttacggttacgtaccgttcggtttaccggtttcggtcgggggtaaccccgg

SEQ ID NO: 343090 - DNA, 693 bp, Homo sapiens
  misc_feature: GZ8MTXP02F7AY4.4.58.F03.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattccccaggtccagcttgtgcagtctggggctgaggtgaagagccgtgggcctcagtgagggtttcctgcaaggcttnggatacncttcagtagttatactatacacgtgggtgcgccgacggccccccgaanaaacgccgttagagtggagtggatcggaatctaacgtctgggacaagtacggacaaacaacaaaatacttacaactagaaagttacgagggacaggacgtacacctaagttaccgaagggacaacataccgacgaacaccagaccctaaacagtaggacgctagacgaccgagacccgtggaacctagttaccgaagaaacggaccgtacgggtacctttaggtaacggtttaacgtttaccgttacgggtttacggaaaacggggttaccgggtacgtttaacgggttccggttacggggttaaaccttacggttttaacggtttaacgtttaggtaacggttaccgtttcccggggttttaaccggttccggggtttacgggggtaaaaccccccgg

SEQ ID NO: 343091 - DNA, 578 bp, Homo sapiens
  misc_feature: GZ8MTXP02HD3GP.4.58.F03.1.454.CMB.2.raw
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (474)..(474): a, c, t, g, unknown or other
  misc_feature (474)..(474): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttccngcaaggcttctggatacaccttcagtagttatactatacactgggtncgccaggcccccgganaaacgcctgagtggatgggatcgatcaactctggcaatggacaaacacaaaatacttacaacagaagttacaggggcagacgtcacctattaccgagggacaacagtaccgacgaaaccacacggaccctaacagtaggacgctagacgcaagccctagaccagtcctagaacgacgaccggntgtctattactcggttcgaaggtaccgggattacggcgttaggggaactttcgttaaagtaagttaaggtcgtacgttcgttcgttcggttcggggaaccccgg

SEQ ID NO: 343092 - DNA, 632 bp, Homo sapiens
  misc_feature: GZ8MTXP02JMAM3.4.58.F03.1.454.CMB.2.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcgagtgagggtttcctgcaaggcttctggatacaccttcagtagttatactatacactgggtncgccacggccccgganaacgcctgagtgatggatcgatcaactctggacaagtcggacaacaactaaaatctacacaagaacgttacagggacagacgtacaacctaagttaccagggaccacactccgaccaaacacacgccctaacgactaggacgctagacgaccgacgacccgtagaaccgtacgttacgaaggaaacgaccgtaaccgggtacttacggtagttaacttacggtcggtttaacggacgggaccgggtacgtaacgggtcgttaggggtacttaacgtttaggttaagtacggttacgtaccgttccggttaccgttaccgggtacggggtaaccccggg

SEQ ID NO: 343093 - DNA, 625 bp, Homo sapiens
  misc_feature: GZ8MTXP02FQR5W.4.58.F03.1.454.CMB.2.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtncgccacggcccccganaaagccttgatttggatgggatcgatcgaactctggcaatggacaaanaacaaaatatacacaagaagttacgagggacagacgtacaaccgtattaacccgaagggaccaacaactcccgaccgaaaccaacaacgaccctaacgataggacgctagaacgcaacgccctgaacctataccgtaggaaacgacgaacgggcttaggtattaagtttaccgtggtttacggaacggtaaccggggtcttaaaggttcgttacggggtaattacgtttaaggtttaagtaggttagtaacgttccggtttcggtttccgtcgggggtaccccgg

SEQ ID NO: 343094 - DNA, 630 bp, Homo sapiens
  misc_feature: GZ8MTXP02FLW6K.4.58.F03.1.454.CMB.2.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctnagtgagggtttcctgcaaggcttctggatacaccttnagttagttatactatacactgggtgcgccacggcccccggacaaacgccttgaggtggagtgggatcgatcaactctggcaagtggacaacaacaaaatactacacagaagtacagggcagacgtcacattaccgaggacacatccgacgaacacagccctacagtaggagctagacgcgacgccctagacacgtcgtagaaacgaccgacgggtaccttggtagttaagtttacgttagggtttaccggaaacgggtaccgggggtactttaaacggggttccgttagggggtaactttaccggttaaaggttttaacgttagggttacggtacccgttttcggttacccgggtttcggtcggggggtaacccccgggg

SEQ ID NO: 343095 - DNA, 623 bp, Homo sapiens
  misc_feature: GZ8MTXP02GMDT1.4.58.F03.1.454.CMB.2.raw
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcagtgagggtttcctgcaaggcttcgtggatacaccttcagttagttatactatacactgggtncgccacggcccccgganaaacgccttgagtggagtgggatcgatcaactcgtggacaagtggacaaacacaaaatactacacaagaattacgagggcagagtacaacctataccgaagggacacactcccgacaacgacacgaccctaacacgtaggacgtccgtagacgaccgacggaccctaggaacctagtacgtacgaaaacgaccgaacgggtaccttaggttagtaactttacgtggttacggtacgggaccgggtcttacggtaccgtaggggtaactacgttaagttaagtaggttacgtaccgttcggttaccgtttcggtacggggtaacccgg

SEQ ID NO: 343096 - DNA, 643 bp, Homo sapiens
  misc_feature: GZ8MTXP02JZ6GQ.4.58.F03.1.454.CMB.2.raw
  modified_base (440)..(440): a, c, t, g, unknown or other
  misc_feature (440)..(440): n is a, c, g, or t
  modified_base (480)..(480): a, c, t, g, unknown or other
  misc_feature (480)..(480): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgtagggtttcctgcaaggtcttctggatacaccttcagttagttatactatacactgggtgcgccacggcccccggacaaacgccttgagtggagtgggatcgatcaactctgggcaatggacaaacgaacaaaaatacttacaactaagaaagttacgaggacagagtacaacctattaccagggtaccacatcccgacgaacaacacgactacataggancgtagagcagccctagacatacgtagaaagaccgaacggngttaggttagttaactttacgttcgggtttaccggtaacggtaaccggggtacgttaacgggttccgtaggggttacgttaccgtttaaaggtttaagttaaaggttacggtaacgtttacccggttcgggttttacccggtacgggggttaaacccccgggg

SEQ ID NO: 343097 - DNA, 662 bp, Homo sapiens
  misc_feature: GZ8MTXP02I1DZ9.4.58.F03.1.454.CMB.2.raw
  modified_base (132)..(132): a, c, t, g, unknown or other
  misc_feature (132)..(132): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctntttttggtggcagcagccacaggtgcccattcccaggtccagcttgtgcagtcgtggggctgaggtgaagaagccgtggggcctcagtgagggtttccnggcaaggcttcnggatacacttnagtagttatactatacactgggtgcgccacggcccccganaaacggccttagagtggagtgggatcgatcgaactcgtagggcaagtcggacaacaaagtaaaatctacactaagtaaacgttacgagggtacagggtactacgaaacctaacgttaccgaagggaacaccgacgtaccgacgaaacaacgacgacctaacgagtacggacgtcgagacgcgaacgaccgttacggacctaacgttcgaaacgaacgaccgacggtacgtggtttacgttaacgttaacgttcggtttaaccgggaacggtacgggtaaccgttagggttaccggttacgggtaacttacggttaagttaacgtaggtacgttaccgtcggttcgttaccggttacggggtaacccgg

SEQ ID NO: 343098 - DNA, 718 bp, Homo sapiens
  misc_feature: GZ8MTXP02HFFCG.4.58.F03.1.454.CMB.2.raw
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (432)..(432): a, c, t, g, unknown or other
  misc_feature (432)..(432): n is a, c, g, or t
tcagagcactgtagcacgaccggtgctcgatttagtctgatcgagaagggaaacgggacccaacaaccacatccctcctcagaagccccagagcacaacgcctcaccatggactggacctggaggatcctcttttggtggcagcagccacaggtgcccattcccaggtccagcttgtgcagtctggggctgagtgaagagcctgggcctnagtgaggtttcctgcaaggcttctggatacaccttcagttagttataccgtatacactgggtncgcccaggcccccganaaagcccttgactggactgggactcgtataccacgtcgtcgactagtcggaaccaacaaacctaaaattacctaccaagaacgtaacgttaacgaggacaggtacacccgactaactaccgagggacaacacgtccgacgaanaacacggtacccctaacacggttagaacgtaccgtaggaccgacggaaaccccgtaccgtacgtaacgtacgtacgtaaacggaaaccgtaaccggtaccggtaacgttacggtttaacgttaacgtttaccgggttacggttaaccgggtaaccgggtaaccggttaccggttaccggttaaccgggtacggttaacgtttaaccggtttaaagttaaacggttacggttaccgttacccggtttaccggtttaccgggtttaccggggtaccggggtaacccgg

SEQ ID NO: 343099 - DNA, 660 bp, Homo sapiens
  misc_feature: GZ8MTXP02H8G7E.4.58.F03.1.454.CMB.2.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatccttctttttggtggcagcagccacaggtgcccattcccaggtccagcttgtgcagtctggggctgaggtgaagagccgtgggcctcgagtgagggtttccngcaaggtcttnggatcacttnagttagttatactatacactgggtncgccacggcccccganaagccttgaggtgagtgggatcgatcaactcgtggacaagtcggacaacaaactaaaatctacacagtaaacgttacgaagggtcagggataccaaccgtacgttacccgagggaaccacaacgtccgacgaaacacgagcccttaacgagttacggacgtaccgtagacgaccacgtcccgtaggacctataccgtaagaaacgaccgtacggtacgttaggtacgtttaactttaccgttacggtttacggaacgggttaccgggtacgttaacggttaccggttggggtaacttttacgttaaggtttaagttacggttacgtaccgtttcgggttacccggtttcggtacgggggtaaccccg

SEQ ID NO: 343100 - DNA, 767 bp, Homo sapiens
  misc_feature: GZ8MTXP02GOYO0.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtgagggtttcctgcaaggcttcgtggatacaccttcagtagttatactatacacgtgggtcgcgccgacggcccccggacaaacgccttaggagttggagttggggatcggatcaacgtcgtgggacaagtcggacaaacaaactaaaataccttacaacgtaagtaaacgttacgaaggggtacaggtacgtacaaccgtaacttaaccgagggaacaacgtactacccggaccgaaaccaccgaagacccttaacgacgttacggacgttacgacggacgtacgaccgtaccgtacggtaccgtaacttaccgttaaacggaaaaccggaacccggttaaccggggtaccgtttaagggtttaaccgtttaaggttttaaaccggttacggggttttaccggaaacgggggtaaccgggttaccggtttaaacgggttccggttagggggtaaccctttacggtttaaagtttaaccggtttaggtttacggtaacccggtttccggtttacggggtttacccgggttaccgggggttaaaccccgggg

SEQ ID NO: 343101 - DNA, 641 bp, Homo sapiens
  misc_feature: GZ8MTXP02GZ52V.4.58.F03.1.454.CMB.2.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgagaagcctgggcctcgagtgaggtttcctgcaaggcttctggatacacttcagtagttatactatacacgtggtncgccacggcccccganaaacgcctgagtgagtgggatcgatcaactctaggcaagtcggacaaacaactaaaatacttacaacaagtaacgttacgaagggtcaggtacgtacaaccctaagttaaccccgaaggggaaccacctaacgtcccgaaccgaaaccaaccgacgacccttaacgacgttcggaacgtcctaggaacgaccgacggtcccgtagaaccgtattaccgtaaggaaagacccgaacggtcgtaggttagtatttacgttcggtttacggacggttacgggaccgttaaggtccggttaggtacttcgttaagttgtaagtcgtacgttcgttcgtttccggacgggtacccgg

SEQ ID NO: 343102 - DNA, 630 bp, Homo sapiens
  misc_feature: GZ8MTXP02I7V3P.4.58.F03.1.454.CMB.2.raw
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagccgtggggcctcgagtggagggtttccngcaaggtcttctggatacaccttcagtagttatactatacacgtgggtncgccacggccccgganaagccttgagtgagtggatcgatcaactcgnggactaagtcggacaaacaactaaaatacgtacaactagtaaacgttacgaggtacagtactacaacctatacccgaggaaccacagtaccgacgaaccactacgacctaacagtacggacgtacgtagacgaccgaaggaccctagaacctacgtacgtaagaaacgaacgtaccggtacgttaggtacgttaacgtttacgtacggtttacggacgggtaacgggtcgttaaaggtcgtaggggtaacttcgttaagttaagtacgtcgtacgttcggtcgttacgggtcggaaccggg

SEQ ID NO: 343103 - DNA, 638 bp, Homo sapiens
  misc_feature: GZ8MTXP02FSBJ7.4.58.F03.1.454.CMB.2.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (340)..(340): a, c, t, g, unknown or other
  misc_feature (340)..(340): n is a, c, g, or t
  modified_base (439)..(439): a, c, t, g, unknown or other
  misc_feature (439)..(439): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagctgggctcagtgaggtttcctgcaagggtcttcgtaggatacgtaccttcagttagttatactatacagtgggtncgccgacggcccccganaagccttggagtggagtggatcgatcaatctggacagtggacaanaaacaaatactacaacgagaaagttacgagggcagacgtacaaacctacttaaccgaggaccacactccgacgaaacacacgactaacagttacggacncgtagagacgaacgccgtagacctacgttacaacgaaacgccgtaacggtcttacggtagtttaaacgtcgtttagtacccggtaaaggggtaccggtacgttaaacggttcgtaagggggttaccttacgttaaaggtttaagtacggttacgtaccgtttaccggtttcggttacgggtacgggggttaacccccgg

SEQ ID NO: 343104 - DNA, 660 bp, Homo sapiens
  misc_feature: GZ8MTXP02GN9A1.4.58.F03.1.454.CMB.2.raw
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccaaaggtgcccattcccaggtccagcttgtgcagtcgtggggctggaggtgaagagccgtgggcctcagtggtagggtttcctgacaggtcttctggatactaccttnagttagttatactatacagtggtcncgccgacggcccccgaanaacgtccttgagtggagtgggatcgatacaacgtcgtaggactaagtcggacaaaacaaactaaaattacttaacccaacgtaagtaaacgttaccgaggggacaaggtacgtaccaaaccgtaacgttaacccgaagggaacaaccacgtacccgacgaaaccaccaacgtacctaacgagtacggagtacgtagacgcgacgtacctacgactagtccgtaggaaacgaccgacggtcttaggttacgttattacgtgttacggaacggtacgggtcgttacggtcggtaggttacgtagttagttagtaacggttagtacgttcggtcggttcggtacggggtaccgtaaccggg

SEQ ID NO: 343105 - DNA, 614 bp, Homo sapiens
  misc_feature: GZ8MTXP02JZVF8.4.58.F03.1.454.CMB.2.raw
  modified_base (229)..(229): a, c, t, g, unknown or other
  misc_feature (229)..(229): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtcccagcttgtgcagtctgggggctgaggtgaagagcctgggcctcagtgaggtttccngcaaggcttctggatacaccttcagtagttanactatacactgggtncgccacggcccccganaagcctgagtggatgggatcggatcaactcngggcaagtggacaacaacaaatactcacagaagttacgagggcagaacgtcaccgtataccgaggacaacatccgacgaacacagaccctacagtgaacgctaggacgcgaacgtacccgtgacctataccgtagaaacgacgacggtctacgggtattaacgtttacgtacggtttacggacggtaccgggtacgttacgggttccgttagggggtacttcgttaagtttaacgaggtttacgtaaccgtttacgtttccgggtttacgtacggggggtaaacccccggg

SEQ ID NO: 343106 - DNA, 569 bp, Homo sapiens
  misc_feature: GZ8MTXP02JN25I.4.58.F03.1.454.CMB.2.raw
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctgggcctcagtgagggtttcctgcaaggcttctggatacaccttcagtagttatactatacactgggtgcgccgacggccccccggaacaaacgccttaggaggtggagtgggatcggatcaactctggacaatggacaacacaaaatactacacagaagttacagggcngagtcaccataccgaggacacactaccgcaacacacgccctaacatggagtcagagacncgaccgtacgacactcgtagaacgacgacgacgtgtagttagttacgttggttacggaggaccgggtctaaggttcgtgggtactacgttagttaagtagtacggtacgtcggtcggtttacggcgggtacccgg

SEQ ID NO: 343107 - DNA, 673 bp, Homo sapiens
  misc_feature: GZ8MTXP02IJ3I7.4.58.F03.1.454.CMB.2.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtgggctgaggtgaagagctgggcctnagtgaggttcngcaaggcttcgngatacaccttcagttagttatactatacacgtggtcgcgccgacggacccccganaaacggtcctagagtggtagtgggatcgatcaacgtcgtagggactaaagtgaccaaaacaaactaaaattacttacaacgtaagtaaacgtttagaaggtacagtacgtaccaaaccgtaacgttaaccgaacgggacctaacgaactaccgaccgaaacaccgacgtaccctaagacgtggacgtactagacgactaacgcctaagacctataaccgtagaaacgaaccgtacggtaccgttaggttagttaacgtttacgttagggttaccggaacgggttacggggtactttacgggtacgttacgggtaactttacgttaagttaagtaggttaccggtacgttccggtttacgtttacgggacggggtaaccccgg

SEQ ID NO: 343108 - DNA, 699 bp, Homo sapiens
  misc_feature: GZ8MTXP02F1RFQ.4.58.F03.1.454.CMB.2.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagccgtggggcctcgagtgagggtttcctgcaaggcttctggatacaccttnagttagttatactatacactgggtncgccgacggcccccgganaaacgccttagacgtgagtgggatcgatcaactcgtggacaagtcggacaaacaactaaaatactacaacaagaaacgttacgaagggcaggacgtaccaaaccgtacgttaacccgaaggggacctaaccgaacgttaccccggaacgaaaccacgaaccgacccttaaacgacgtaggacgtcgtacgacgaccgacgtcccgtagaccgtacgttacccgaggaaaccgacgaccggtaccgttaggttacgtttaacgttaacggttcggttaacggacgggttaaccggggtaccgttaggttacggttacggggtactttacggtttaaagttaagtttacggtacgttaccggttcggtttaccgggtttaccgggtacggggtaaaccccggg

SEQ ID NO: 343109 - DNA, 614 bp, Homo sapiens
  misc_feature: GZ8MTXP02JRJYK.4.58.F03.1.454.CMB.2.raw
  modified_base (290)..(290): a, c, t, g, unknown or other
  misc_feature (290)..(290): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagcctggggcctcagtggaggtttcctgcaaggcttctggatacaccttcagtagttatactatacactggtgcgccacggcccccganaaacgccttagagtggatgggatcgatcaactctgcatggacaacgaacaaaatacttacactagaagttacgagggacagacgtcaccaattaccgaagggacacactacccgacgaacacacgacctacataggaacgcgtagacgacagaccctagaaccatccgtagaaacgaccgtacggtacgttaggttagtttaacgtttacgttacggttaccggacgggtaaacgggtccgttaaggtccggttagggtaacttcgttaaggttaatacgggttagtaccgttcgtttcggtttaccggttacggggtacccgg

SEQ ID NO: 343110 - DNA, 688 bp, Homo sapiens
  misc_feature: GZ8MTXP02F5ZRR.4.58.F03.1.454.CMB.2.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (476)..(476): a, c, t, g, unknown or other
  misc_feature (476)..(476): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctggaggtgaagaagccgtggggcctcagtgtagggtttccngcgaaggtcttcgtggataccaccttcgtagttagttatactatacacgtgggtnccgccgaccggacccccgaanaaacgtccgttagaggtggagtgggtatcgatcaactgnggacaagtggaacaaacaaactaaaatctacaataagtaagttacgaggacagacgtacaaccgtaattaaccgaaggacaacgtaccaccgaaccgaacaacgacgaccctaacgagtaggacgtanaggacgacgaacgccgtacgactacgttaccgaaggaaaccgtacgtaccggtcttaacgggttagttaaacgtttccgttagggttaaccggaacgggttaccgggggtacttaaacgggttcggttacgggttaacttaaccggtttaagttaaggttacgtacggttaccgttacggtttccgggttacggtacgggggtaacccccgg

SEQ ID NO: 343111 - DNA, 629 bp, Homo sapiens
  misc_feature: GZ8MTXP02I6H83.4.58.F03.1.454.CMB.2.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (477)..(477): a, c, t, g, unknown or other
  misc_feature (477)..(477): n is a, c, g, or t
tcagagcactgtagcacgaccggtgctcgatttagtctgatcgagaagggaaagggacccaacaaccacatccctcctcagaagccccagagcacaacgcctcaccatggactggacctggaggatccttctttttggtggcagcagccacaggtgcccattcccaggtccagcttgtgcagtcgtgggctgaggtgaagagccgtgggcctgagtggtagggtttcctgcgtaaggtcttcgtggactactaccttcagttagttatactaatacacgtgggtcncgaccgacggaccccccganaaacgtccgttagagtggagtggatcgatacactcgtgggactaagtcgactaaacaaacaaaattactacaagagtaacgtacgagggacagataccaaacgtacgttaaccgaggtaaccacgaccgtaccgaccgaaacacgtacacctacagtcgacgtccagaacncgaacgtaccgtagacctatacgtaagaaacgtacgacggttgtagttacgttagtttacaggttacggaggtaccggtcgtaaacgtcggtgggtaaacttggttaagttaacgtagtacgtacgttcgtcgttagggtaccggtaaccgg

SEQ ID NO: 343112 - DNA, 615 bp, Homo sapiens
  misc_feature: GZ8MTXP02JXCQ3.4.58.F03.1.454.CMB.2.raw
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtcgtggggctgaggtgaagaagccgtggggcctcagtgagggtttcctgcaaggtcttctggatactaccttcagtagttatactatacactgggtcgccgccgacggacccccggaacaaacgcctttaggagtggagtgggatcgatacaactcgtggacaatggaacaacaaacaaaatactacaanaagaagtacgaggacagatacactagtaccgaggaaccacacnccgaacgaacacgacgaccctaagagtcggagngtagaacgcgaagcctacgacactcgtaagaaacgacgacggcgttagtagtacgttacgtgttacggaacggacggggttctacggtcggtacggtagttacgttaaggtttaagacggttagtacggttccggttacggtttacggggtacggggtaaccccgg

SEQ ID NO: 343113 - DNA, 589 bp, Homo sapiens
  misc_feature: GZ8MTXP02FOS55.4.58.F03.1.454.CMB.2.raw
  modified_base (293)..(293): a, c, t, g, unknown or other
  misc_feature (293)..(293): n is a, c, g, or t
  modified_base (468)..(468): a, c, t, g, unknown or other
  misc_feature (468)..(468): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagttagtatactatacactgggtgcgccaggcccccggaanaaacgccttgagtggatgggatcgatcaactctggcaatggacaaacaacaaaatacttacacagaaagttacgagggcagagtacaccattaacccagggacacatcccgacgaacacagccctacattgggacgctagagcagcctagactatcgtagaacgacaaccgggtnttagtattaacgttacgtcggttacggaggtacgggtacgttaggttcgtagggtaacttacgtttaaggttaagttacggtacgttacgttccggtttcggttcgggtacggggtacccg

SEQ ID NO: 343114 - DNA, 696 bp, Homo sapiens
  misc_feature: GZ8MTXP02G9PGY.4.58.F03.1.454.CMB.2.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagccgtggggcctnaggtggtacgggtttccngcaaggtcttcgaggactacctaccttacagttagttataactatacacgtgggtgccgaccgacggcccccggaacaaacgccttaggaggtggagtggggatcggatacaactcgtagganaatggacaaacgaanaaaatacttacaacgtagaaaagttacgaggggcaggacttaccaaccgtaattaacccgaggggaactaaaccgacgtacccgaccgaaaccgaacacgacccgttaacacgtaacggacggtaccgtagaacggaccttacgggccctacgtaacgatacgtaacggaaacgaaccgacggtacgttagtagttaacgtttacgttaccggtttagggaacggtacggggtacgtttaacgggtcggttacgggtagttcgtttaaggtttaagtacggttacgtcgtttacggttcggtttaaccggtcggggtaacccggg

SEQ ID NO: 343115 - DNA, 633 bp, Homo sapiens
  misc_feature: GZ8MTXP02I3ING.4.58.F03.1.454.CMB.2.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (332)..(332): a, c, t, g, unknown or other
  misc_feature (332)..(332): n is a, c, g, or t
  modified_base (524)..(524): a, c, t, g, unknown or other
  misc_feature (524)..(524): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatccttctttttggnggcagcagccacaggtncccattcccaggtccagcttgtgcagtcgtgggctgaggtgagacgcctgggcctgagtgtagggtttccctgcgtaaggtctttcgtaggtaacttacctacctttcgaagttaacgtttaataacttaattaccgtaacgtggggtacgccggcccgacgggaccccccgaanaaacggtcccgttaggagttggacgtagggacttcggatactaacgtcgtaggacaagtcgaacctaaacgaaactaaaatctacaacgtagtaaacgttacgacggggacagggtactacaaaccgtacgtaccgacggacactacgacccgacgaacacgacgcctacagtagacgtcagagacacgtcngacatcgtaagagacgacggttntagtntagtacgtgtacgagtacgtcgtagtacgtcgtagttagttagtaagtagtacgtacgttcgtacggttacggacggtacg

SEQ ID NO: 343116 - DNA, 619 bp, Homo sapiens
  misc_feature: GZ8MTXP02HKUUM.4.58.F03.1.454.CMB.2.raw
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
  modified_base (453)..(453): a, c, t, g, unknown or other
  misc_feature (453)..(453): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccaaaggtgcccattcccaggtccagcttgtgcagtctgggctgaggtgaagagccgtgggcctcgagtgagggtttccngcaaggcttcgtggatacacttcagtagttatactatacagtgggtgcgccacggcccccggaanaaacgccttgagtggatgggactcgatcaactctggacaagtggacaaacaacaaaatatacccaacaagtaacgttacgaggacaggacgtaccaaaccgtacttaccgaagggtaacaactacgtaccgacgaaaccacgacgacctacagtgggacncgtagacgcagaccctgaactgtacgtagaacgacgcggtactggtagttacgttacgtaggttcggaacggtacgggtcttacggtcgttacgggaactttacggttaagttacgtaaggtcgtaaccgttcggttacggttcggacgggggtacgtaaccgggg

SEQ ID NO: 343117 - DNA, 693 bp, Homo sapiens
  misc_feature: GZ8MTXP02IKDVT.4.58.F03.1.454.CMB.2.raw
  modified_base (295)..(295): a, c, t, g, unknown or other
  misc_feature (295)..(295): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtctggggctggaggtgaagaagcctgggcctcgagtgtacgggtttcctgcaaggtcttctggatacaccttcagtagttatactatacacgtggtgcgcacggccccganaaagcctgagtggatggatcgatcaactcgtagggacaagtggacaaacgaaactaaaattaccttacaacgtaaggtaaagttacgaggggacaggtacgtacaacccgtaacgttacccgaagggacctaacgacgtacccgaaccaaacgaaccaacggaccctaacgacgtacgggagtaccgtagacgaccgaacggtaccctaggtaacctagtaccgtaagaaaccggaacgtaccgggtacttaggttacgttaaacgtttacgttacggtttacggaacgggtaaccgggtacgtttaaggtaccggttaggggtaaactttacgttaaaggtttaacgttacggtacgtaacgttccggtttacggtttccggtacggggtaacccgg

SEQ ID NO: 343118 - DNA, 658 bp, Homo sapiens
  misc_feature: GZ8MTXP02F75PE.4.58.F03.1.454.CMB.2.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (477)..(477): a, c, t, g, unknown or other
  misc_feature (477)..(477): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagaagccgtggggcctcgagtggacgggtttcctgcgaaggcttcgtggatacaccttnagttagttatactatacacgtgggtgcgccgacggacccccganaaacgtccttgagtggagtgggatcgatctaactcgaggacaagtcggacaaacgaaactaaaagtacttacaacaaagtaagttacggaaggactagactaccaacctaacttaccgaacggactaacgactacccgacgaaacacgacaccgtaacagtggagctagganaccgaagcctagactactacgtacgaaacgaccgacggtaccgttgttacgttaacgtttcgtacggttcggaacggtacgggtacgtaaccggttcggttaaggtacgtttacgtttaaggttaacgttaggttacgtaaccgtttcggttaccggtttcgggaccggggttaaccccgg

SEQ ID NO: 343119 - DNA, 625 bp, Homo sapiens
  misc_feature: GZ8MTXP02FE6IN.4.58.F03.1.454.CMB.2.raw
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattccccaggtccagcttgtgcagtctgggggctggaggtgaagaagccgtggggcctcagtgaggggttttcctgacaaggctttctggatacaccttcagttagttaatactatacactgggtagcgccacggccccccggacaaagccttgagtggatgggatcgatcaactctggcaatggcaacacaaaatacttacacagaagttaacagggacagacgtacacctagttaccaggggaacaacactacccgacgaaacacagccctaacatagggagcctagacgacagcctggaaccattaccaggaaacgacgacggtctggtattagtttactcggtttacgaacggtacggggtacttacgggtacgtacggggttagtaccttttaggttaagtaacgggtttacgtaaccggttcgtttacggttaccgggtcgggggtaaacccccgggg

SEQ ID NO: 343120 - DNA, 581 bp, Homo sapiens
  misc_feature: GZ8MTXP02JG5WH.4.58.F03.1.454.CMB.2.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattccccaggtccagcttgtgcagtctggggctgaggtgaagaagccgtggggcctcagtgagggtttcctgcaaggcttctggatacaccttcagttagttatactatacacgtgggtncgccacggcccccganaaacgccttgagtggatgggatcgatcaactctggacaatggacaaacacaaaatctacaacagtaaacgttacaggggacagacgtacaacctaagttaaccgagggaacaacatccgacgaaacacagccctaacgatgggaactcgtagacgacaacgtccgtagaacacgttcgtaagaaacgaccgacggtactagtacgttatacgtagttccgaggtacggtctagtcgaggtactctaggttaacagtcgtacttcggtcgttcggacgggtacccg

SEQ ID NO: 343121 - DNA, 762 bp, Homo sapiens
  misc_feature: GZ8MTXP02H38JO.4.58.F03.1.454.CMB.2.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatcctctttttggtggcagcagccacaggtgcccattcccaggtccagcttgtgcagtctggggctggaggtgaagagcctggggcctcagtggaggtttccngcaaggcttctggatacaccttcagtagttatactaatacactgggtncgccacggcccccganaaacgccttagaggtcggagtgggancggtaataccaacttcgtaggctaaagtcgggacaaaccgaaactaaaaagttaccttacaaaccgtaagtaaaacggtttaccgaaaggggacctaggtacgttaacaaaccccgttaagttaacccgaacgggggtaaaccctaaacgtaaccgttacccgggaaacccggaaaaccgaacccgtaaacgggaacccccttaaacgtaacgttacggggaaacgtacccggtaggaaaccgtacgtaaaccggaccccgttaacggactaacgttaccggtaggaaaacggtaccgaaccgggttaccgtaggttacggttaaagtttacgttacgggtttacggaaaacgggttccgggtacgttacggtacggtagggtcttacggtagtttaagtaggttacgtacgttcggttacggttaggtccggggaacccgg

SEQ ID NO: 343122 - DNA, 655 bp, Homo sapiens
  misc_feature: GZ8MTXP02FJ3W8.4.58.F03.1.454.CMB.2.raw
  modified_base (230)..(230): a, c, t, g, unknown or other
  misc_feature (230)..(230): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagagccgtggggcctcagtgagggttttccngcaaggcttctggataccaccttcagttagttatactatacacgtgggtgcgcccgacggccccccggaacaaagccttggagtggagtggatcgatcaactctaggcaagtgacaaacactaaaatactacacaagaagttacgaggggacaggactaccgaacctaacgttaacccgaaggggtaaccaacaaccgttacccgaacccgaaaccaaccgaacggtaccccttaaacgacgttagggacgtccgtaggaacgaccgtacggaccttacggaacctagtacgtaggaaacgaaccggacgtcgtagtagttattacgtgttacggacggtacgggtcgttacggtacgtacggggtattacgttagttaacgtagttacggtacttcggtttcggtttccggtacggggacccgg

SEQ ID NO: 343123 - DNA, 596 bp, Homo sapiens
  misc_feature: GZ8MTXP02FTHK4.4.58.F03.1.454.CMB.2.raw
  modified_base (141)..(141): a, c, t, g, unknown or other
  misc_feature (141)..(141): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (492)..(492): a, c, t, g, unknown or other
  misc_feature (492)..(492): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggnggcagcagccacaggtgcccattcccaggtccagcttgtgcagtcgtggggctggaggtgaagaagcctggggcctnagtgagggtttccngcaaggcttcnggatacnccttnagtagtatactatacactgggtncgccgacggtccccccggaanaaacgtccttaggagtggaatggggactcggatcaacgtctgggacaagtgacaaacaactaaaatctacaacgagtaagtacgagggacagggtacacaactataccgaaggacaactagaccgacaacactacacctaanagngacgcgagacgacgacgtacctagacagtacgaagaacgacgtacgtntagtattagttacgtggtacggaggtacggtacgtacggtcgtaggtacttacggttaagttaacgtacggtacgtacgttcgttacggtcgggtacgggaccg

SEQ ID NO: 343124 - DNA, 618 bp, Homo sapiens
  misc_feature: GZ8MTXP02G4AHW.4.58.F03.1.454.CMB.2.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctggaggtgaagaagccgtggggcctgagtgtagggtttccngcaaggtcttcgtggatacctaccttcgagttagttatactatacacgtgggtcncgccgacggcccccgaanaacgtccttgagtggagtgggatcgatcaactcgagacaagtggaacaaacaaactaaaatactacaactaagaagttacagggacagcgtacaacctagtaccgaaggacacacgtacccgacgaaacacgacgaccctacgacgtaggacgtcagacgacaacgtccgtacgactagtccgtaagaaacgacgaacggtcgtagttacgttagttacgtggtttacggacggtacggcgttaggcgtagggtaccttagttagttaacgtgttacgtaccgttgttcggttcggtacggggtaacccgg

SEQ ID NO: 343125 - DNA, 611 bp, Homo sapiens
  misc_feature: GZ8MTXP02FTU3P.4.58.F03.1.454.CMB.2.raw
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtggggctgaggtgaagagccgtggggcctgagtgaggtttccngacaaggtcttctggactacacttcagttagttatactatacacgtgggtncgccgacggcccccganaacgtccttagagtgagtggatcgatcaactcgaggacaagtcggacaacaaactaaaatcttacaactaagtaacgttacgagggacagacgtaccaactattaccgaaggaccacgactccgacgaacacgacgacctaacgagtcggatcgtagacgacgacgcctagaacagttaccgaggaaacgaccgacggtattaggtcttaaagtttccgtaggttacggaggtacggtcttaaggtcgtagggtaccttgttaagttaagtacggtcgtaccgttcggtacgttccggtacgggtaacccgg

SEQ ID NO: 343126 - DNA, 765 bp, Homo sapiens
  misc_feature: GZ8MTXP02GW5GW.4.58.F03.1.454.CMB.2.raw
  modified_base (232)..(232): a, c, t, g, unknown or other
  misc_feature (232)..(232): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagccgtggggcctcgagtggagggtttccngcgaaggcttcgtggatacaccttnagttacgttatactatacacgtgggtcncgccacggcccccggaanaaacgtccttagagtggagtgggatcgatcaactcaggtacaagtcggacaacgaactaaaatacttacaacagtaaacggttacgagggtacaggacgttaccacccgtaagttacccgaaggggtaccaacgaacgtcccgaacgaaaccacgaacgaccctaacacgtaggaacgcgacggaacgaccgtacgacccgtcggaacctacgttacccgtaaggaaaccgaaccgtaacccggggtccttaagggtttacggttaaacgtttaccggttagggtttaacccggaagggggtaaccgggggtttaccgttaaaaggggtttccggttaacgggggtaactttacgggtttaaaacgttttaaacgggttaacggtttaacggggttaaaccccgttttaccggggtttcccggttttaaccggggttccggggggtttaaaaccccccgggg

SEQ ID NO: 343127 - DNA, 678 bp, Homo sapiens
  misc_feature: GZ8MTXP02JSIH0.4.58.F03.1.454.CMB.2.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttctttttggtggcagcagccacaggtgcccattcccaggtccagcttgtgcagtcgtggggctggaggtgaagagccgtgggcctgagtgaggtttccngcaggtcttcgnggatacaccttcagttattatactatacacgtgggtcnccgccgacggcccccgaanaacgtccttagagtggagtgggatcgatacaactcgtaggcaagtggaacaaacgaactaaaattcctacaacgtaagtaaacgttacgaaggggtcacggtacgtaccaaaccgtaacgttaacccggaacggggtaacccaaacgtaccgtacccggaaccgaaaccgaaccgaccgtaccctaaacgagtacgggacgtaccgtagacgacgacgtacccgttagaccctaagtacgtaacgaaacgtaccgtaacggtcttaggttacgttacttacgtcggttacggaggtccgggtacgttacggtcgtagggtacttacgtagttaacgtacggtacgtaccgttcggtcggttacggacggggtaacccg

SEQ ID NO: 343128 - DNA, 713 bp, Homo sapiens
  misc_feature: GZ8MTXP02GHKDR.4.58.F03.1.454.CMB.2.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (417)..(417): a, c, t, g, unknown or other
  misc_feature (417)..(417): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatccttctttttggtggcagcagccacaggtgcccattcccaggtccagcttgtgcagtcgtggggctgaggtgaagaagccgtggggcctcagtgaggtttcctgcaaggcttcnggatacaccttnagtattatactatacacgtggtgcgccgacggcccccggaacaaacgccccttaggacgttagggagttaggggattcggaattcaaaacttcgtacgggaccaagttcgggaaccaaacgaactaaaaataccttacaaccaagaaacgttaacgaacgggntgggaaacttcaaaccagtttaacccgaacggggaacaaccgaacgtccgaaccggaaacaaaccgtacgacccttaaccgaagttcggaacggccttaggagaccgacggtaccctacgtacatacccgttagaaaacgacccgtaaagggtctacggttagttacttaacgttggttaccgaggtaccggggtagtttacggtaccttagggggtaactaccggtttaaggttaaacgttaggttaccggtaacgttacggttcccgttaagggtttcggggtaaaccccgggg

SEQ ID NO: 343129 - DNA, 609 bp, Homo sapiens
  misc_feature: GZ8MTXP02GCFXS.4.58.F03.1.454.CMB.2.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (375)..(375): a, c, t, g, unknown or other
  misc_feature (375)..(375): n is a, c, g, or t
tcagagcactgtagcacgaccggtgctcgatttagtctgatcgagaagggaaagggacccaacaaccacatccctcctcagaagcccccagagcacaacgcctcaccatggactggacctggaggatccttctttttggtggcagcagccacaggtgcccattcccaggtccagcttgtgcagtctggggctgaggtgaagaagccgtggggcctcgagtgagggtttcctgcaaggtcttnggatacacttnagttagttatactatacactgggtncgccaggcccccgganaaagccttgagtgatgggatcgatcaacttctggcaatggacaaacgaacaaaatcttacacgaagaacgttagacggganagagcaacgacttaccgagggaacacacgtcccgagaaaccacacgaccttacagtacggagctaggagcgagtaccgtacgaactataccgttagaaccgacgtaaccggcgttaggttaggttactttacgttacggtttccgaaaagggtaccgggtcgttaaaggtctagggggttactgttaagttaacgtaagtgtaccttcggttcggtttcgtcggggtaacccgg

SEQ ID NO: 343130 - DNA, 639 bp, Homo sapiens
  misc_feature: GZ8MTXP02JEX9G.4.58.F03.1.454.CMB.2.raw
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
tcagagcactgtagcacgaccggtgctcgatttagtctgatcgagaagggaaaggggacccaacaaccacatccctcctcagaacgcccccagagcacaacgcctcaccatggactggacctggaggatccttcttttttggtggcagcagccacaggtcgcccattcccaggtccagtcttgtgcagtcgtggggctggaggtgaagagccgtggggcctgaggtgtagggtttcctgcgtaaggtcttcgtggtactactaccttcgagttagttatactatacgcgtggtcgccgccgacggacccccgaanaacgtccttagagtggagtggatcgatcaactcgnggacaagtcggaacaacaaactaaaataccttacaacgtaagtaacgttacgacgggacagggtactaccaaaccgtaacgttaccgaggaccacgacgtaccgacgaacacgtacgacctagacgtgacgtcgtagcacgtacgcctagagtactacgtaagaacgacgttcggtaggttgttacgttactttacgtaggttaccggacggggtaccgttcgtaagttccggtaggttacttgttaataagttacgtcgttacgtcggttcgtcggtacggtacccgg

SEQ ID NO: 343131 - DNA, 607 bp, Homo sapiens
  misc_feature: GZ8MTXP02IBORG.4.58.F03.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
tcagagcactgtagcacgaccggtgctcgatttagtctgatcgagaagggaaaggggacccaacaaccacatccctcctcagaagccccagagcacaacgcctcaccatggactggacctggaggatcctctttttggtggcagcagccacaggtgcccattcccaggtccagcttgtgcagtctggggctgaggtgaagaagcctggggcctcagtgtaggtttccngcaaggtcttcnggatacaccttcagtagttatactatacactgggtacncgccgacggcccccganaaacgtcctaggagtggagtgggactcggaatcaaactcgtgggcaagtggaccaaacgaaactaaaatcttacacaagaagttacgaaggctagagttccaaactacttaaccgagggaaccaacacaccgacgtaacncgaactccctaagacgtaggacgacngaacgcgaacgccctagacctatccgagaacgtacgacggtgtagtacgttacgttacgtagtacggacggtacgggtacttacggtcgttacggactttagtagttaagtagtacgtacgttcggttcgttcggtacgggtaccg

SEQ ID NO: 343132 - DNA, 670 bp, Homo sapiens
  misc_feature: GZ8MTXP02JQ31A.4.58.F03.1.454.CMB.2.raw
  modified_base (153)..(153): a, c, t, g, unknown or other
  misc_feature (153)..(153): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
  modified_base (468)..(468): a, c, t, g, unknown or other
  misc_feature (468)..(468): n is a, c, g, or t
tcagagcactgtagcacgaccggtgctcgatttagtctgatcgagaagggaaaggggacccaacaaccacatcccctcctcagaagcccccagagcacaacgcctcaccatggactggacctggaggatcctctttttggtggcagcagccanaggtgcccattcccaggtccagcttgtgcagtcgtggggctgaggtgaagagccgtgggcctnagtgaggtttcctgcaaggcttcgnggtatactaccttcagttagttatactatacacgtgggtnccgaccacggccccgaanaaacgtccttaggagtgatgggatcgatcaactcgtaggactaagtcggacctaaaacaaactaaaataccttacaacaagtaaacgttacgaggacagtacgtacacctataccgaaggaccanacgcgacgaacacacgtaccctaanacgtacggagcgtagaacnccgacgttacccgagaaccctagtacgtaacgaaacgaaccggaccggtacgttagttaacgttaacgtttaccgtagggtttaccggaagggtacgggttaacctaacggtttacggaacgggttaactttaccgttaaagttaagttagttacgttaccgttacggtttacggtttacggggtacggggtaaaccccggg

SEQ ID NO: 343133 - DNA, 635 bp, Homo sapiens
  misc_feature: GZ8MTXP02GQ7UX.4.58.F03.1.454.CMB.2.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagagcactgtagcacgaccggtgctcgatttagtctgatcgagaagggaaaggggacccaacaaccacatccctcctcagaagcccccagagcacaacgcctcaccatggactggacctggaggatcccttcttttttggtggcagcagccacaggtgcccattcccaggtccagcttgtgcagtctggggctgaggtgaagagcctggggcctgagtggtacgggttttctgngaaggtcttcgtggattaacctcctttgaagttagttattaactatactacgtgggtgcgccgacggcccccgaanaaacgccttgagtggagtggatcgatcaactctgacagtgacaaacaactaaaatctacgacaagtaacttaacgagggacagacgtacaacgtattacccgaaggaccactacgaccgacaaacgacacgacctacgactacggaacgtcgtagacncgaaacnccgtacaacgacgtacgtaagaaacgtaccgacgtgttacgttagttacttacgtacgttacgaagggtccggtaacgttacgttcggtaacggttacttacggtttaagttaaggttacgttacgtacgtttcggttcggttacggtacggggtacg

SEQ ID NO: 343134 - DNA, 516 bp, Homo sapiens
  misc_feature: GZ8MTXP01BXIQU.22.21.B10.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
  modified_base (506)..(506): a, c, t, g, unknown or other
  misc_feature (506)..(506): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacaagtntgtctctggtaccaacaccacccaggcacacgcccccaaactcatgatttatgagtcactaagcggcctcgaggggtccctgatcgcttctctcggctcaagtctggcgacncggcctccctgacccgtctctgggcctccgaggctgaggatggaggctgattattactgctactcatatgcaggtcgcaactcgttgggtgttcggcggaggaaccaagctcgaccgtccgtaggttcagcccaaggctcgcccctggttccncgttcctccg

SEQ ID NO: 343135 - DNA, 554 bp, Homo sapiens
  misc_feature: GZ8MTXP01DQMZB.22.21.B10.1.454.CMB.2.raw
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtatgtctctgtacaacaccaccaggcacacgacccccaaactcatgatttangagtcactaagcggctcgagggtccctgatcgcttctctcggctcaagtctggaccacnccggccctccctgacccgtccgtcgtcggggcctccgaggtctggagtatggaggtctgtattattactgtacttactcgattatgcaggcgctaacgttgttgggtgttcgggcggagggaacaagcgtcggaccgtaccgtaggttcgacggcccgaaggtcctccggtcccccgtcggttcctaaccgttccgttccccg

SEQ ID NO: 343136 - DNA, 573 bp, Homo sapiens
  misc_feature: GZ8MTXP01EGUVC.22.21.B10.1.454.CMB.2.raw
  modified_base (298)..(298): a, c, t, g, unknown or other
  misc_feature (298)..(298): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtggttacaagtatgtctctggtaccaacaccacccaggcacacgaccccaaactcatgatttangagtcactaagcggcctcgaggggtccctgatcgcttctctcggcctcaagtctggaccacaacggccctccctcgtacccgtctcgtgggcctccgagtcgtgagatggaggcttgacttatactgtactatacattatgacgaggccggctaacgttcgttgggtcgttcgggcgggagggaaccaagttccgtcgacccgtcgtacggttccgacgaccccgaagggtccctccggtccccccgttcggttaccctaaccttccgttccccg

SEQ ID NO: 343137 - DNA, 513 bp, Homo sapiens
  misc_feature: GZ8MTXP01B6TSX.22.21.B10.1.454.CMB.2.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (478)..(478): a, c, t, g, unknown or other
  misc_feature (478)..(478): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatctcctgcactggaaccngcagtgacgttggngttacaagtntgtctcctggtaccaacaccacccaggcacagcccccaaatcatgatttangaggtcactaagcgggcctcgagggggtccctggatcgcttctctcggcctcaagtctggaccgacncggcctccctgaccgtctcgtgggctccgagctgagatgaggctgattattactgctactcgatatgcaggcgcaactcgtgggtgttcggcggaggaaccagctgaccgtcaggttcngcccgaaggcctcgccccctggttctcttcgtccg

SEQ ID NO: 343138 - DNA, 530 bp, Homo sapiens
  misc_feature: GZ8MTXP01EYIGI.22.21.B10.1.454.CMB.2.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
  modified_base (453)..(453): a, c, t, g, unknown or other
  misc_feature (453)..(453): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccagcagtgacgttggtgttacagtntgtctctgtaccaacaccaccaggcacacgccccaaatcatgatttangaggtcactaagcggcctcgaggggtccctgatcgcttctctggcctcaagtctggcaacncggcctccctgaccatctctgggctcaggctgaagngtgaggtctgattagtactgctggctctatttgctaggccgcctacgtacgttggggtcgttcgggnggaacgggacgaaggcttcgaccgtcttagggttccacggcccaaggcctccggcccccttgggtccttcgttcccg

SEQ ID NO: 343139 - DNA, 572 bp, Homo sapiens
  misc_feature: GZ8MTXP01BNJKE.22.21.B10.1.454.CMB.2.raw
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtntgtctctgtaccaacaccaccaggcacacgacccccaaatcatgatttangagtcactaagcggcctcgacgggtccctgactcgcttctcgtcggcctacgaagtctcggaccgaccgccgggccctccccgtcggaccccgttcgtccgtcgggtccctcccgaggcctggaggntggagctagtacttattacctgtaccttactcgattagtcgcgaggccgctaacgttcggttgggtcgttcgggcggacgggaaccaagcgtcgaccgtcgtaacgttcgacgcccgaagcctccggccccgtggttcctaaccgttcgtcccg

SEQ ID NO: 343140 - DNA, 534 bp, Homo sapiens
  misc_feature: GZ8MTXP01EYO97.22.21.B10.1.454.CMB.2.raw
  modified_base (291)..(291): a, c, t, g, unknown or other
  misc_feature (291)..(291): n is a, c, g, or t
  modified_base (405)..(405): a, c, t, g, unknown or other
  misc_feature (405)..(405): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtatgtctctggtaccaacaccacccaggcacagccccaaatcatgatttangagtcactaagcggcctcgaggggtccctgatcgcttctctcggctcaagtctggcgacaacggcctccctgaccgtctctgggctccaggctgaggatgagctgatattactnctactactatatgacgaggcgcgtacgtcgttgggtggtcggtcgggacgggaacgaacgacgtcgttaccgtaccgtacgttacgcgaccgaacggcgtccgccccgtccgttccgtccgttcgtccg

SEQ ID NO: 343141 - DNA, 595 bp, Homo sapiens
  misc_feature: GZ8MTXP01DLH15.22.21.B10.1.454.CMB.2.raw
  modified_base (295)..(295): a, c, t, g, unknown or other
  misc_feature (295)..(295): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctgtaccaacaccacccaggcacacgacccccaaatcatgatttangagtcactaagcggcctcgacggggtccctgatcgcttctctcggcctcaagtctggaccgacgcggtccctcccgtgaccccgtctcgtcggggctccgaggctggaggatggaggctagtatttattactgacttactcgaaattgtgacgaggccggtactaaacgttcgtttgggggtcgtttacggggcgggtaagggaaccctaaggcgtacggttaacccgtcgtaagggttccgcggaccccgaagggtccctccggtcccccgtcgggttacctccgttccgtttccccgg

SEQ ID NO: 343142 - DNA, 590 bp, Homo sapiens
  misc_feature: GZ8MTXP01DDY1L.22.21.B10.1.454.CMB.2.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtaccaacaccaccaggcacacgcccaacacnatagttattagaggtacgactaacgtacgggcccgtctacgggtaccggtcctagtcgtcgttcttcgtccgcgtctaacgtactcggacgacaaccgcctcctccgacgtccgtcgtcgggcgtccctcgacgtcgaggaacgtgaacggggtntcgtagttaattcgttacncttactagtatatgcgacgcgactacgttacggttgggtcggtcggcgggacggaacgtaacgcgtcgttaccgtaccgtacgcgcgacccgaacgtccgtcccgccccggtccgttactcccgttcgtcccg

SEQ ID NO: 343143 - DNA, 541 bp, Homo sapiens
  misc_feature: GZ8MTXP01ANGVO.22.21.B10.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctggtaccaacaccaccaggcacacgcccccaaatcatgatttangagtcactagcggcctcgagggtccctgactcgcttctctcggctcaagtctggccacncggcctccctgacccgtntcgngggctccgagctgaggatggaggtctagtatttattactgcttactcgtaatagtcgacgaggccggactaacgttcgttgggtcggttcgggcgggagggaaccaaggcgtacgaccgtctaggttcgcgcccgaaggcctcgcccctggttcctcgttcgtcccg

SEQ ID NO: 343144 - DNA, 530 bp, Homo sapiens
  misc_feature: GZ8MTXP01EJA7F.22.21.B10.1.454.CMB.2.raw
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (432)..(432): a, c, t, g, unknown or other
  misc_feature (432)..(432): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctctggtaccaacaccacccagcacacgcccccaaatcatgatttangagtcactaagcggcctcgacggggtccctgatcgcttctctcggctcaagtctggaccgacnccggcctcccgtgacccgtctcgtcgggcctccgaggctggaggactggacgctagattatactgactatcaattntgcaggccgactacgtcgttgggtgttcggcggaggaaccaagcgtcgaccgtctaggttcacgcccgaagcctcgcccctggcctaacgttctcccg

SEQ ID NO: 343145 - DNA, 611 bp, Homo sapiens
  misc_feature: GZ8MTXP01BWVL2.22.21.B10.1.454.CMB.2.raw
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaagggggggtctcaggaggcagcgctctcgggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctctgtaccaacaccaccaggcacacgacccccaaatcatgatttangagtcacgtaagcggctcgacggggtccctgactcgcttctctggccctaccagtctggccgaaccaccgggtccctcccgtcgacccgttctcgtcggggcctaccgaggctggaggatggagtctgtattattactgactactcatagtgacgacgggcgaccgtaacgttcggtttgggggtcggttccggggacgggacgggaaccgaaaggtcgttacggtacccgttcgtacgggtccaccgggttccccgaacgggtccctcccggtcccccgttcgggtcccttaccgttcccgttccggttaacccccc

SEQ ID NO: 343146 - DNA, 514 bp, Homo sapiens
  misc_feature: GZ8MTXP01EWSKO.22.21.B10.1.454.CMB.2.raw
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (480)..(480): a, c, t, g, unknown or other
  misc_feature (480)..(480): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggnggttacaagtatgtctcctggtaccaacaccacccaggcacagcccccaaatcatgatttangaggtcactaagcgggcctcaggggtccctgatcgcttctctcggctcaagtctggcgacncggcctccctgaccgtctcgtgggctccaggctgaggatggaggctgattattactgctactcgattatgcaggcgcaactcgttggtgttcggcggagggcctaagctgaccgtctagggttcngcccaaggctcgccccctggttcaacgttctccg

SEQ ID NO: 343147 - DNA, 572 bp, Homo sapiens
  misc_feature: GZ8MTXP01BA6S4.22.21.B10.1.454.CMB.2.raw
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtatgtctcctggtaccaacaccacccaggcacacgaccccaaactcatgatttangagtcactaagcggcctcgacggggtcctgatcgcttctctcggctcaagtctggcgacncggcctcccgngacccgtctcgtgggcctccgaggctggagntggaggctgtattacttacgtgtcttactcgtaattatcgacgtagggccgactaacgttccggttggggttcgttcggggacggggagggtaaccgaaggcgtacggaccgtcgtacggttcgcgacccgaaggtccgtccgccccgtcggttacctaaccgttcgttccccg

SEQ ID NO: 343148 - DNA, 509 bp, Homo sapiens
  misc_feature: GZ8MTXP01B2QZH.22.21.B10.1.454.CMB.2.raw
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctctggtaccaacaccacccaggcacagcccccaaatcatgatttatgaggtcactaagcggcctcagggggtccctgatcgcttcnctcggctcaagtctggcacncggcctccctgacccgtctcgtgggctccgaggctgagatgaggctgattatactgctactnatatgcgnggcgcacgtcgtggtgtcggcggagaacagctgaccgtcgtagcgcgaccgaaggtcctccgccccgtcgttcctaaccgttccgtcg

SEQ ID NO: 343149 - DNA, 547 bp, Homo sapiens
  misc_feature: GZ8MTXP01DU47P.22.21.B10.1.454.CMB.2.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctgtacaacaccaccagcacacgaccccaaatcatgatttangagtcacgtaagcggcctcgacggggtccctgatcgcttctctcgctcagtctggccgacncggcctccctgaccgtctcgtcgggctccgagctgaggatggaggtctgtacttattacgtntactactntatagngacgaggcgactaacgttcggttgggtcggttcgggacggacgggaacctagcgtacggaccgtcgtacggcgcgacccgaaggccctccggccccgtcggttacctccgttccgtccg

SEQ ID NO: 343150 - DNA, 540 bp, Homo sapiens
  misc_feature: GZ8MTXP01BZCZ7.22.21.B10.1.454.CMB.2.raw
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtatgtctctggtaccaacaccacccaggcacacgacccccaaactcatgatttatgagtcactaagcgggcctcgacggggtccctgactcgtcttctctcggcctcaagtctggccgacncggcctccctgacccgtctcgngggctccgagctggagntgaggctgattattacngactactcattatgcgaggcgactaacgttcgttgggtgttcgggcgggagggaacagcgtacgaccgtcgtaggttcgacgcccgaaggcctccgcccctggttacctccgttcgttcccg

SEQ ID NO: 343151 - DNA, 593 bp, Homo sapiens
  misc_feature: GZ8MTXP01CEWMG.22.21.B10.1.454.CMB.2.raw
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtatgtctctgtaccaacaccaccagcacacgaccccaaatcatgatttangagtcacgtaagcggcctcggacgggtcccngactcgcttctcgtcggcctacgaagtcgtggacccgaacgtcccggccctcccgtacggtaccccgtcgtcggtcgggccctcccgaggtcctagggaggtagtggaggtctagtatttacgtactcgacttactgattagcgcgaggcgactaacgttcggttgggtcggtacgggcggaacgggtaaccaaggcctacggacccgttcgtaggccgttacggacccgaagggccctccggccccgtggttacctaaccgttcgtttccg

SEQ ID NO: 343152 - DNA, 574 bp, Homo sapiens
  misc_feature: GZ8MTXP01E3B5J.22.21.B10.1.454.CMB.2.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggttacaagtntgtctctggtaccaacaccacccaggcacacgcccccaaactcatgatttangaggtcactaagcggcctcgagggggtccctgatcgcttctctcggctcaagtctggacacnccggccctccctgaccgtctcgtgggcctccgaggctggaggagtggaggtctagtatttattactgtactactcgaattagtcgcgaggcggactaacgttcgttggggtgttcggggcgggtaacgggaaccaaggcgtacggaccgtcgtaacggttcgacggcccgaaggccgtccgtcccccgtcggttcctaaccgttccgttccccg

SEQ ID NO: 343153 - DNA, 570 bp, Homo sapiens
  misc_feature: GZ8MTXP01BOF7N.22.21.B10.1.454.CMB.2.raw
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtntgtctctgtaccacacaccagcacacgccccaaatcatgatttangagtcactaagcggcctcgacggggtccctgatcgcttctctcggctcaagtctggccgacncggccctcccgtgacccgtctcgtgggcctccgagctgaggatggaggctagtatttatactgacttacctagtatatgacgaggccggctaacgttcggttggggtgttcgggcgggtaagggaacccaaggcgtacggacccgttcgtacggttaccgacggaccccgaagggtccctcccggtcccccgttcgggttccctaaccgttccggttccccg

SEQ ID NO: 343154 - DNA, 573 bp, Homo sapiens
  misc_feature: GZ8MTXP01BT8IC.22.21.B10.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (519)..(519): a, c, t, g, unknown or other
  misc_feature (519)..(519): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacaagtntgtctctggtaccaacaccacccaggcacacgcccccaaatcatgatttangaggtcaactaagcggcctcgaggggtccctgatcgcttctctcggctacaagtctggacacnccggcctcccgtgacccgtctcgngggcctccgaggctggaggatggaggctgattattactgacttactcgattagtcgacgagggccggactaacgttcgtttggggtcgttccgggcgggacggggaaccaaggctcggacccggttccgtagggttccncggacccgaagggcccttccggcccccgtcgggttacctccgttccgttcccgg

SEQ ID NO: 343155 - DNA, 545 bp, Homo sapiens
  misc_feature: GZ8MTXP01AHME0.22.21.B10.1.454.CMB.2.raw
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtggttacaagtntgtctcctggtaccaacaccacccaggcacacgcccccaaactcatgatttatgaggtcactaagcggcctcgaggggtccctgatcgcttctctcggctcaagtctggcgacnccggcctcccgtgacccgtctcgtcggggctccgaggctggaggatggaggctgattattactgctactcgaatatgcgaggcgcaacgttcgttggggtgttcgggcgggagggaaccaagcgtacgccgtccgtaggttcgcgcccgaagccgtcgcccccgtggttcctccgttcgtccccg

SEQ ID NO: 343156 - DNA, 540 bp, Homo sapiens
  misc_feature: GZ8MTXP01A4QFY.22.21.B10.1.454.CMB.2.raw
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccagcagtgacgttggtgttacagtntgtctctgtacacacacccagcacacgccccaaatcatgatttangagtcactaagcggcctcgaggggtccctgactcgcttctctcggctcaagtctggcacncggcctcccgtgaccgtctcgtgggctccgaggctggagatggaggctagatttagttactgacttactcatagtgcgaggcgcaacgtcgttgggtgttcggcggagggaaccaagcgtcggaccgttccgtaggttcgcgcccgaagggtccctccggcccccgttcggttaccctaaccgttccgttcccg

SEQ ID NO: 343157 - DNA, 637 bp, Homo sapiens
  misc_feature: GZ8MTXP01D9E4S.22.21.B10.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagcctccctccgcgtccggtctccgtggacagtcagtcaccatctcctgcactggaaccngcagtgacgttggtgttacagtntgtctctgtacacaccaccagcacacgaccccaatcatgatttangacgtacacctaacccgccctcgacgggtccctgactcgtcttcgccgctaccccagtctggaccaaccgaccggccctccctgaccctatcctcgtcggacctccgagtctaggacgtagtgggtacggttacgttacgttttacgcgcttcgcttactacgttaggtcggacgtaacggtactaaacttaattaacgttagttacgggttccgttacggggacggtaacgggaaccgtaaaacggtcgttaacccggttaccgttaaggtaccgaacggacccgttaaggcccgtcccgccccgttcggtcctaccgttccgtaacccgtttccccgtaaccccg

SEQ ID NO: 343158 - DNA, 564 bp, Homo sapiens
  misc_feature: GZ8MTXP01EFM36.22.21.B10.1.454.CMB.2.raw
  modified_base (291)..(291): a, c, t, g, unknown or other
  misc_feature (291)..(291): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacatggtcctgggcccagtctgccctgactcagcctccctccgcgtccaggtctcctggacagtcagtcaccatctcctgcactggaaccagcagtgacgttggtgttacagtatgtctctggtaccaacacaccagcacacgcccccaaatcatgatttangagtcaactaagcggcctcgaggggtccctgatcgcttcctctggctccaagtctggcgacacgggccctcccgtgacccgtctcgtgggcctccgaggctggaggatggagtctagattattactgcttactcatagtgcgaggcggactaacgttcgttgggtcgttcgggcgggtaagggaccaaagcgtacgtaacccgttcccgttaaggttccgaacggaccccgaaagggtccctaccggttcccccgtcgggttcccgtaacccg

SEQ ID NO: 343159 - DNA, 558 bp, Homo sapiens
  misc_feature: GZ8MTXP01ANEGL.22.21.B10.1.454.CMB.2.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccagcagtgacgttggtgttacagtntgtctctgtaccacaccaccagcacacgccccaaatcatgatttangagtcacgtaagcggcctcgacggggtccctgactcgcttctctcggctacgagtctggacgacnccggccctcccgtgacccgtctcgtcgggcctccgaggctggacggtatggaggtcttagtaactttagttactgacttactctaattagtcgacgacggcgactaacgttcggttggggtcgttcgggacggacggaaccaagcgtcggacccgtcgtaggccgcggcccgaagtcctccgcccctggcctccgttcgtcccg

SEQ ID NO: 343160 - DNA, 560 bp, Homo sapiens
  misc_feature: GZ8MTXP01EFZGZ.22.21.B10.1.454.CMB.2.raw
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
tcagacatacgcgtcacgaccggtgctcgatttagtgtcgtcgcaagggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagcaaaccccccaatcatcattanggtntcactcgtcggccctcaggatctctcatcgcttctccaggctccaagtctaggcaacncgcctccctaaccatctctgggctccagttgagacgagtctacttattactgcagttactttaaattaggggacgtcctaacttctcgttcggttttcggcggtacggcgacccgaagtcgaccgtccgttcggttctacggcccaaaggtccttcgttcccccttcgggtcacctcctcgtccccaccctcccgttctaacccg

SEQ ID NO: 343161 - DNA, 541 bp, Homo sapiens
  misc_feature: GZ8MTXP01AP6VF.22.21.B10.1.454.CMB.2.raw
  modified_base (244)..(244): a, c, t, g, unknown or other
  misc_feature (244)..(244): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtacaacaccacccagcacacgccccaaactcatgatttatgagctacactaagcgggcctcgacggggtccctgactcgcttctcctggctcaagtctaggccgaacncgggccctcccgtcgaccgtctcgtcgggctccgaggctgaggntggaggctgattattactgtactactcaagtatcgcaggcgctaactcgttgggtgttcgggcgggaagggtacccaggcttcggaccgtcgttaggttcacgccgaggcctcgccccgttagtccgttcgttcccg

SEQ ID NO: 343162 - DNA, 546 bp, Homo sapiens
  misc_feature: GZ8MTXP01A9KHI.22.21.B10.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtgttacaagtntgtctctgtaccaacaccaccaggcacacgccccaaatcatgatttangagtcactaagcggcctcgacggggtccctgactcgcttctctcggctacaagtctggacgacnccggccctccctcgaccgtctcgtgggcctccgaggctgagatggagtctttatattactgcagctcatagtggagcagcgataagtttggtgtcgggcggagggaaccaaggctacggaccgtaccgtaggttccgcgacccgaaggtcctaaccggccccgtcggttcctaaccgttccgttcccgg

SEQ ID NO: 343163 - DNA, 631 bp, Homo sapiens
  misc_feature: GZ8MTXP01BMUCX.22.21.B10.1.454.CMB.2.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagccctcctcactcagggcacagggtcctgggcccagtctgccctgactcagccctccctccgcgtccggtctccgtggacagtcagtcaccatctcctgcactggaaccngcagtgacgttggtgtacagtntgtctctgtaccaacaccaccaggcacacgaccccaancatgatttangagtcaactagcggcctcgacgggtcccngactcgcttctcgtcgctacaagtctcggacgacgccggccctcccgtcgtacccgtctcgtgggccctccgaggcctggaggtacgtggagggtcttaggatttagttactgtacttactcgtattagtcgacgtaaggccgtacctaacgttccggtttgggtcggttaccggggcgggaacgggaaccgaaacggttccgtaccggacccggttaccgtaacgggttccgaccggttacccccgaaagggtcccctccccggtcccccccgttcgggttcccttaacccgttcccgtttccccccgg

SEQ ID NO: 343164 - DNA, 560 bp, Homo sapiens
  misc_feature: GZ8MTXP01AWQJA.22.21.B10.1.454.CMB.2.raw
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtaccaacaacaccaggcacacgcccccaaatcatgatttangagtcactaagcggcctcgaggggtccctgatcgcttctctcggctcaagtctggcacncggccctccctgaccgtctctcgggctccgaggctgaggatggaggctgattatactgacttactcgatatgcgaggcgactaacgttcgttggggtcgttcgggcgggacggggaaccaaggccttacggacccgttccgtaaggttcccgacggaccccgaagggtccttccggcccccgttgggttcctaaccgttcgttccccg

SEQ ID NO: 343165 - DNA, 615 bp, Homo sapiens
  misc_feature: GZ8MTXP01AIZ06.22.21.B10.1.454.CMB.2.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (411)..(411): a, c, t, g, unknown or other
  misc_feature (411)..(411): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctggtaccaacaccaccaggcacacgaccccaaactcatgatttangagtcataaggcggctcgacgggtccctgactcgtcttctcgtcggcctacaagtcgtggaccgaccgccggccctcccgtcgacccgtctcgtcgggcctccgaggcgtggacggngtggaggtctaggtatttacgttactagtacttacttacgtaattacgtgaccgtacgggccggtacgtaaccgttccgggttttggggtcgggttaccggggacggggtacgggaaccgaaggttccgtacgttaccggtccgtacggttcgacggacccgaaggccgtccgcccccgtcggttacctccgttccgttccccg

SEQ ID NO: 343166 - DNA, 533 bp, Homo sapiens
  misc_feature: GZ8MTXP01DXA1X.22.21.B10.1.454.CMB.2.raw
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtatgtctctggtaccaacaccacccaggcacacgcccccaaatcatgatttangaggtcactaagcggcctcgagggtccctgactcgcttctctcggctcaagtctggcgacncggcctcccgtgacccgtctcgtgggctccgagctgaggntggaggctgattattactgctactcatatgcgaggcggcaacgttcgttgggtgttcgggcggtagggaaccaagcgtcgaccgtcgtaggttcgcgcccgaaggcctccggcccctcggttcctcgttccgttcccg

SEQ ID NO: 343167 - DNA, 536 bp, Homo sapiens
  misc_feature: GZ8MTXP01EMVHM.22.21.B10.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacaagtntgtctctgtaccaacaccaccagcacacgaccccaaatcatgatttangagtcactaagcggctcgagggtccctgatcgcttctctcggctcaagtctggccacnccggccctcccgtcgacccgtctcgtcgggctccgaggctgagatgaggtctgattattacngtactactntatagtgcgaggcgctaactgttgggtgttaccgggnggacgggaaccaggcgtacgccgtctacgggttcacggacccaaggcctccgccccgtcggttcctaaccgttctcccg

SEQ ID NO: 343168 - DNA, 563 bp, Homo sapiens
  misc_feature: GZ8MTXP01B628K.22.21.B10.1.454.CMB.2.raw
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtatgtctctggtaccaacaccacccaggcacacgcccccaaactcatgatttangagtcactaagcggctcgaggggtccctgatcgcttctctcggcctcgaagtcgtggaccacnccggccctccctgacccgtctcgtgggctccgagcgtgaggatggagctgattattacgtgtctactcgatagtcgcgaggccgctaacgttcgttgggtcggttcgggcgggtagggaaccagttcgtcggttaccgtaccgtaggttccgcggaccccgaaggtccctccgcccccgtggttccctaaccgttccgtttccccg

SEQ ID NO: 343169 - DNA, 558 bp, Homo sapiens
  misc_feature: GZ8MTXP01DUATI.22.21.B10.1.454.CMB.2.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (426)..(426): a, c, t, g, unknown or other
  misc_feature (426)..(426): n is a, c, g, or t
  modified_base (547)..(547): a, c, t, g, unknown or other
  misc_feature (547)..(547): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctccngcactggaaccngcagtgacgttggtgttacaagtntgtctctggtaccaacaccacccaggcacacgacccccaaatcatgatttatgaggtcactaagcggcctcgacgggtccctgatcgcttctctcggcctcaagtctcggaccgacaaccgggccctcccgtcgacccgtctcgtcggggcctccgagctgagatgaggctgattattacngtactactcaattatgacgtaggccggtcaacgttcgttgggtcgttcgggacgggtaggggaaccaaggcctcggaccgtacgtaggttcgcgacccgaaggcctcgcccctggttaccncgttcgtcccg

SEQ ID NO: 343170 - DNA, 614 bp, Homo sapiens
  misc_feature: GZ8MTXP01DGOSJ.22.21.B10.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccagcagtgacgttggtagttacaagtntgtctcgtgtaccaacaccaccagcacacgaccccaaatcatgatttangagtcacgtaagcggcctcgacgggtcccngactcgtcttctctcggcctacgtaagtcgtggaaccgaacctccggccctcccgtcggtaccccgtcgtcgtacgggccttcccgaggtctaggaggtagtggaaggtctagttaactttactaccgttcgtaccttactacgtaatacgtcgacgacggtcgtacgtacggttcgggttcgggtcggtaccggggacggacggaacgtacggttccgtacgttaccgtaccgtcgaccgacgaccgtaacgtcccgtcccgtcccgtcgttcctccgttccgtcccg

SEQ ID NO: 343171 - DNA, 568 bp, Homo sapiens
  misc_feature: GZ8MTXP01BWV21.22.21.B10.1.454.CMB.2.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (517)..(517): a, c, t, g, unknown or other
  misc_feature (517)..(517): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacaagtntgtctctgtacaacaccaccagcacacgccccaaatcatgatttangagtcactaagcggcctcgagggtccctgatcgcttctctcggctacaagtctggccgacncggccctcccgtgacccgtctcgtcgggaccctcgaggcgtaggaggtagtggacggtcttagtaattagttactgtctactcattagtgacgtaggcggactaacgttcggttgggtcggttcgggcgggacgggaaccaaggcgtacggaccgtcgtacggccgnggaccccgtaagggcctccgcccccgtcggttacctaaccttcgttccccg

SEQ ID NO: 343172 - DNA, 676 bp, Homo sapiens
  misc_feature: GZ8MTXP01D17E9.22.21.B10.1.454.CMB.2.raw
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccaacaccacccaggcacacgacccccaaactcatgatttangagtcactaagcgccctcgacggggtccctgaccgtattctctggccctctaagtctggccaaccctcggccctccctggaccatcaggtcgccctccgggtccgagagtgaggcttaggatttattacgtgtcgcagctaagggttggggtaactttaaccgaaccgttggtaacgttcgtaagtttacccggttaagggtttcgggggttcggtttccgggggcgggggtaaacgggggaaccccgttagggggtacccgttcggggtaaaccccggttcccggttaacggggttcccgaacgggtaacccccgaaacgggtccccgttccccgggaccccccccgtttcggggttccccttaacccggttttcccccg

SEQ ID NO: 343173 - DNA, 607 bp, Homo sapiens
  misc_feature: GZ8MTXP01AT51Y.22.21.B10.1.454.CMB.2.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctggtaccaacaccacccaggcacacgcccccaaatcatgatttangaggtcactagcggcctcgacgggggtccctggatcgcttctcgtcggtctcgtaagtctggccgacnccggccctcccgngacccgtctcgtgggcctccgaggctaggaggatggacggtctagtatttacttacgtcgtactactacgtagttagtagggacgggtccaggctaacgttaaagttttgggtacggttcgggacggggtaacgggaacctaaggcccgtagttacccggtaccgtagggttcccgacggttacccgaagggccctccggcccccgtcgggttcctaaccgttccttccccg

SEQ ID NO: 343174 - DNA, 667 bp, Homo sapiens
  misc_feature: GZ8MTXP01CCBV0.22.21.B10.1.454.CMB.2.raw
  modified_base (314)..(314): a, c, t, g, unknown or other
  misc_feature (314)..(314): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgactagttgggtaggttaacaagtatgtctccgtaggtaacccaacacccacccaggccaaccaccgaccccaaactcatgtatttangagtacaacgtaaggccgggcctacgacggggtccctagactcgtcttctcgtcggctcgaagtcgtacggaccgcgaccggtccctcccgtcgtacccgtcgtcgtcgggtcctaccgaggtcgtggacggtagtcggtacggtcttaggtaactttacttaacgtcgtaccttacgttactaagttacgtcggacgtacgggtccgtacgttaaccgtttcgggttgggggttcggttacggggcggggtaacgggtaaccgaacggtccgttaccggtacccggtccgttacggcgaccggaacccgtaggtcccgtcccggccccgttcggtaaccttccgtttccccg

SEQ ID NO: 343175 - DNA, 561 bp, Homo sapiens
  misc_feature: GZ8MTXP01DRZOC.22.21.B10.1.454.CMB.2.raw
  modified_base (242)..(242): a, c, t, g, unknown or other
  misc_feature (242)..(242): n is a, c, g, or t
  modified_base (343)..(343): a, c, t, g, unknown or other
  misc_feature (343)..(343): n is a, c, g, or t
  modified_base (395)..(395): a, c, t, g, unknown or other
  misc_feature (395)..(395): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcaggacacagggtcctgggcccagtctgccctgactcagcctccctccgcgtcccgggtctcctggacagtcagtcaccatcctcctacactggaaccagcagtgatgttggtgttanaactatgtctctggtacaacagcaccaggcaaacgccccagactcatcattatgctgtacaaataacgccggccctcgacgggggtccctgatcgcttccnctggctcagtctgcacacgcctcctgaccatctctggctcgagctagaacgntagaggctagtattattactggtctgtctctatttcgcgtacggccgtcctaacgtcggttgggttcggttaacgggcgggttaacgggacgaacgtccgtcgacccggttcgttaacggtccaacggcccgtaacggcccgttccgtcccccgttcggttaaccc

SEQ ID NO: 343176 - DNA, 558 bp, Homo sapiens
  misc_feature: GZ8MTXP01DMSCQ.22.21.B10.1.454.CMB.2.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (431)..(431): a, c, t, g, unknown or other
  misc_feature (431)..(431): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtagttacaagtntgtctctggtaccaacaccaccaggcacacgaccccaactcatgatttangagtcactaagcggctcgaggggtcccngatcgcttctctcgctcaagtcnggcacncggcctccctgaccgtctcgtcgggctccgagtctggaggtatgagtctttattattactgcagctacgatagtggagnacgcgtaactaagtttggtggttcgggcgggtagggaacaaggttcgtacgttaccggtccgtaggttccgcggttaccccgaaggtccctccgcccccgtcggttacctcccgttccgtttccccg

SEQ ID NO: 343177 - DNA, 595 bp, Homo sapiens
  misc_feature: GZ8MTXP01ADP7D.22.21.B10.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (285)..(285): a, c, t, g, unknown or other
  misc_feature (285)..(285): n is a, c, g, or t
  modified_base (355)..(355): a, c, t, g, unknown or other
  misc_feature (355)..(355): n is a, c, g, or t
  modified_base (537)..(537): a, c, t, g, unknown or other
  misc_feature (537)..(537): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgtacagtntgtctctgtaccaacaccaccaggcacacgccccaaactcatnatttatgagtcactaaggcggcctcgagggtccctgactcgtcttctcgtcgctcaagtctcggacgacnccggcctcccgtcgacccgtctcgtcgggtctccgaggctgaggatggacggacttgaactttaacgttcgtacgtaccttactctaattatcgacgacgggcggctaacgttcgttcggggtggttccgggcgggaacgggaaccgaaggccgtacggacccgttaccgtacgggttaccncggaccccgaaggtcctcccggcccccgtcgggttcctaaccgttcccgtttccccgg

SEQ ID NO: 343178 - DNA, 562 bp, Homo sapiens
  misc_feature: GZ8MTXP01EIGEZ.22.21.B10.1.454.CMB.2.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (496)..(496): a, c, t, g, unknown or other
  misc_feature (496)..(496): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccngctagttacgtggtgtacagtntgtctctgtaccaacacaccagcacacnccccaaatcatgattangagtcagtaagcggctcgacgggtccctgactcgcttctcgtcggccctaccgaagttcgtacggccgtaaaccgacccgggtccctcccgtacggacccgttcgtccgtcggggctcccgaggtcctaggaggatggacggtctagtattactacgtntacttaacnctaagtatcggacgacggcgactaacgtcgttgggtgtcggnggacggaccaagcttcggaccttcgaggtcacgccttaggcctcgccctgcacgtccttcgtcccc

SEQ ID NO: 343179 - DNA, 583 bp, Homo sapiens
  misc_feature: GZ8MTXP01BLM2K.22.21.B10.1.454.CMB.2.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtagttacaagtntgtctctggtaccaacaccacccaggcacacgacccccaaactcatgatttangagtcaactaaggcggcctcgacggggtccctgatcgcttctctcggctcaagtctggccgacncggcctccctgacccgtctcgtgggcctccgaggctggaggatggaggctagtattattactgactactcgattagtcgcgaggcgacgtaacgttcggttggggtggttccgggacgggtacgggaacctaaggccgttacggacccggttaccgttaacggccgacgcccgtaagggcccgtccgcccccgtcggttacctaaccgttcccgttccccg

SEQ ID NO: 343180 - DNA, 561 bp, Homo sapiens
  misc_feature: GZ8MTXP01C848M.22.21.B10.1.454.CMB.2.raw
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccacccaggcacacgcccccaaactcatgatttangagtcacgtagcggcctcgaggggtccctgatcgcttctctcggctcaagtctggcacncggccctcccgtgacccgtcncgtgggcctccagctgagatgaggctgattattactgctactcgtatagtgcgaggccggcaacgttcgttgggttggttccgggcgggtaagggaaccgaagccgtacgacccgtccgtaacgggttccgacggccccgaagggccctccggccccctcggttcctaaccgttccgtttccccg

SEQ ID NO: 343181 - DNA, 556 bp, Homo sapiens
  misc_feature: GZ8MTXP01DKN6Y.22.21.B10.1.454.CMB.2.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (489)..(489): a, c, t, g, unknown or other
  misc_feature (489)..(489): n is a, c, g, or t
  modified_base (549)..(549): a, c, t, g, unknown or other
  misc_feature (549)..(549): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacagtntgtctctgtaccaacaccaccaggcacacgacccccaaatcatgatttangagtcacgtaagcggcctcgacggggtccctgactcgcttctcgtcggcctacgaagtctaggaccaacgccggtccctcccgtgacccgtctcgtcggggcctccgaggctaggaggactggaacggcttaggtaatttattactgactagcgttacagtacgtggagcagacgtaactagtttggtgtcgggnggaacgggacagcgttagtaccgtcgttaggttcacgccgagcctcgccccgttggtccncgttccg

SEQ ID NO: 343182 - DNA, 576 bp, Homo sapiens
  misc_feature: GZ8MTXP01DY58N.22.21.B10.1.454.CMB.2.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaaccagcagtgacgttggtgttacagtatgtctctgtaccaacaccaccagcacacgaccccaatcatgtatttagngagtacactaaggcggtcctcgacgggtcctgactcgtcttctctcggctactagtctcggaccgacnccggtccctcccgtgtacccgttctcgtcgggcctccggngtcgtggagtgtggagtctagtacttacgtacgtcgtactactacgtagttgtcgacgacggcgtacgtacgttggttcgggtcggtacgggacggacggaacgcgttcgtacgttcgtaccgtacgcgacgccgaacgtccgtccgtcccgtcgttcctccgttccgtcccg

SEQ ID NO: 343183 - DNA, 531 bp, Homo sapiens
  misc_feature: GZ8MTXP01DLC4N.22.21.B10.1.454.CMB.2.raw
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (520)..(520): a, c, t, g, unknown or other
  misc_feature (520)..(520): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtatgtctctggtacaacaccaccaggcacacgccccaaactcatgatttatgaggtcactaagcggcctcgaggggtccctgatcgcttctctcggctccaagtctggcgacncggcctccctgaccgtctcgtgggctccgaggctgagntgaggctgattattactgcttacncgattagtgcgaggcggcaacgttcgttggggtcgttcgggcggagggaacccaagcttagacccgtctaggttcgacgcccaaggcctcgcccctcggttacncgttcttcccg

SEQ ID NO: 343184 - DNA, 618 bp, Homo sapiens
  misc_feature: GZ8MTXP01BSQCN.22.21.B10.1.454.CMB.2.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (448)..(448): a, c, t, g, unknown or other
  misc_feature (448)..(448): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagccctccctccgcgtccggtctcctggacagtcagtcgccatcnctgcactgaaccngcagtgacgttggtgtacagtntgtctctgaccaacaccaccagcacacgacccccaaatcatgtatttangagtacaactaaggcggcctcgacgggtcctgactcgtcttctcgtcggcctacaagtctggaccacnccggtccctcccgtcgaccgtctcgtcgggcctcggacgtctaggacggtatggacggtctaggtatttaacttactgtaccttaaccntaatagtcgacgtaagggccgtaactaacgttccggtttggggtccggttacgggaccgggtaaggaacccgtaaggttccgttaaccggacccgttacgtacggttaccgcgacccggtaaggtccctcccggtcccccgtggttacctcccgtttcccgttaaccccg

SEQ ID NO: 343185 - DNA, 638 bp, Homo sapiens
  misc_feature: GZ8MTXP01EKQUU.22.21.B10.1.454.CMB.2.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagccctccctccgcgtccggtctccgtggacagtcagtcaccatctccngcactggaaccngcagtgacgttggtagttanaagtntgtctctgaccacaccaccagcacacgaccccaatcatgtatttangagtacaacgtaaggcggtcctcggacggggtccctgactcgtcttctcgtcggcctacgagtccgcggaacacgccggtccctccgtcgaccgtcgtcgtcgggtacctccgaggctaggaggagtggaggtcttagtaatttacgttacgtgtaccttactactaagttacgtcgacgacggccgaccttaacggttcgggttggggttcggttacggggacgggaacggggaacctaacgggttccgttaccggacccggttccgttaacggaccgaccggaaccccggtaacgggtccctcccggtcccccgtcggttaccctccgttcccgttcccccg

SEQ ID NO: 343186 - DNA, 576 bp, Homo sapiens
  misc_feature: GZ8MTXP01AD3IY.22.21.B10.1.454.CMB.2.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctccngcactggaaccngcagtgacgttggtgttacaagtntgtctctggtaccacaccaccaggcacacgccccaaactcatgatttangagtcactaagcggcctgacggggtccctgatcgcttctctcggctcaagtctggaccgacnccggccctcccgtgtacccgtctcgtcgggcctccgaggctcggaggagtgagggctagtattattactgacttactcgatagtgcgaggccgctaaccgttcggttgggtggttcgggacgggtagggaaccgaaggttccgtacggaccgttacgtaacggttccgacggacccgaaggcctccggccccccgttcgggttcctccgttccgttccccgg

SEQ ID NO: 343187 - DNA, 549 bp, Homo sapiens
  misc_feature: GZ8MTXP01AQBYW.22.21.B10.1.454.CMB.2.raw
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
  modified_base (533)..(533): a, c, t, g, unknown or other
  misc_feature (533)..(533): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtaccaacaccaccagcacacgccccaaactcatgatttatgaggtcacgtaagcgggcctcgagggtccctgactcgcttcnctcggctcaagtctggcgacncggcctcccgtgaccgtctcgtgggctccgagctgaggatgaggctgattattactgctactcgattangcgaggccggcaacgttcgttggggtgttcgggcgggagggaacaaggcgtcggaccgtcgtagggttccgcggacccgtaaggccttccggcccccgtcgggttaccnccgttccgtttccccg

SEQ ID NO: 343188 - DNA, 516 bp, Homo sapiens
  misc_feature: GZ8MTXP01B96A9.22.21.B10.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
  modified_base (393)..(393): a, c, t, g, unknown or other
  misc_feature (393)..(393): n is a, c, g, or t
  modified_base (476)..(476): a, c, t, g, unknown or other
  misc_feature (476)..(476): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacagtntgtctctggtaccaacaccaccaggcacacgcccccaaactcatgatttatgaggtcactaagcggacctcgacgggtccctgatcgcttctctcggctcaagtctggccgacncggcctcccgtgaccgtctcgtgggctccagctgagntgaggctgattattactgctactcatatgcaggcgcaagtcgtggtgtcggcggtaggccagcgtgaccgtcgtaggttccgngcccgaaggctccgccccgtggttcctaacgttcgtcccg

SEQ ID NO: 343189 - DNA, 582 bp, Homo sapiens
  misc_feature: GZ8MTXP01AS4AL.22.21.B10.1.454.CMB.2.raw
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcacgcctccctccgcgtccggtctcctggacagtcagtcaccatcctcctgcactggaaccagcagtgacgttggtgttacagtntgtctcctgtaccaacaccacccaggcacacgcccccaaactcatgtatttangaggtcactaagcggcctcgacggggtccctgactcgtcttctctcggctcagtctggacacncggcctccctgccctctcgtgggcctcgaggctggaggatggacggcttagatttatactgacttacgtcattagtcgccgtaagggccggctaaacgttcggtttgggggtcggtttcgggcgggaacgggaaccaacggttcgtccgaccggttccgtaaggttccgaccggcccgaaggcccgtccgtcccccgtggttcctaaccggttccttccccg

SEQ ID NO: 343190 - DNA, 610 bp, Homo sapiens
  misc_feature: GZ8MTXP01CS898.22.21.B10.1.454.CMB.2.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagccctcctcactcagggcacagggtcctgggcccagtctgccctgactcagcctccctccgcgtccggtctctggacagtcagtcaccatctcctgcactggaaccagcagtgacgttggtagtacaagtntgtctctgtaccaacaccaccaggcacacgaccccaaancatnattangagtcatagcgcncgagggtccngatcgtcttctcgtcgcctacagtcgtggacaccgcggccctcccgtagaccccgtctcggtcgggctcccaggtctaggacggtatcggaggtcttgtaactttagtaactcggtacttaactctaaagttgacgacgacggaccgtaccgtaaccgtttccgggtttgggtcgggtttaccggacggggtaacggaacctaaacggccgttacgggacccgtacggtacgggttaccacggcccgtaacgggcttaacccgtcccccgtggttccctaaccgttcgttccccgg

SEQ ID NO: 343191 - DNA, 629 bp, Homo sapiens
  misc_feature: GZ8MTXP01CH7GW.22.21.B10.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
tcagacatacgcgtcacgaccggtgctcgatttagtgtcgtcgcaaggggggggtctcaggaggcagcgctctcgggacgtcaccaccatggcctgggctctgctcctcctcagcctcctcactcagggcacagggtcctgggcccagtctgccctgactcagcctccctccgcgtccggtctcctggacagtcagtcaccatctctgcactggaacngcagtgacgttggtagttacagtntgtctctgtaccaacaccaccagcacacgaccccaaatcatgtatttangagtacacgtaaggcggctcgacgggtccctgactcgcttctcgtggcccctcagtcgtcggctaaaccgaccggtccctccctcggacccgttctcgtcgggcctaccgaggtcgtaggagtagtggaaggtcttagtaactttagttactcgtacttactataagttctcggcgtacgggcgtaccgtaacgttcggttaggggttcgttcggggacgggacggtaaccgaacggtccgttcgggtaacccgttcgtaacggtccgaccggcccgaacgggtcccgtccggtcccccgttcggtccttaccgttcccgttcccgtttaaccccccg

SEQ ID NO: 343192 - DNA, 616 bp, Homo sapiens
  misc_feature: GZ8MTXP01DZRXG.22.21.B10.1.454.CMB.2.raw
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctggtaccaacaccacccaggcacacgacccccaaatcatgatttangaggtcactaagcggctcgaggggtccctgatcgcttctctcggctcaagtctggcgacncggcctccctcgacccgtctcgtggggctccgaggctggaggatggaaggctgtaatttattacgtgacttactcgtaatatgacgaggccggactaaacgtttccggtttggggttcggtttacggggcggggaacgggaacccgtaaaggccgttacggttacccgttccgttaacggggttccgacggttaccccgaaacgggtcccgttcccggcccccccgttgggttaccctaaccgttcccgtttccccggg

SEQ ID NO: 343193 - DNA, 615 bp, Homo sapiens
  misc_feature: GZ8MTXP01ELG4K.22.21.B10.1.454.CMB.2.raw
  modified_base (219)..(219): a, c, t, g, unknown or other
  misc_feature (219)..(219): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactgaaccngcagtgacgttggtgtacagtatgtctctgtacaacnccaccaggcacacgaccccaaatcatgatttangaggtcactaagcggcctcgacgggtccctgatcgcttcnctcggctcaagtctggaccgacncggccctcctgacctctcgtcgggcttccgaggctaggagatgaacggcttagaatttataccgtgtactacctntaattcgtcggacaacgggcggtacctaaacgttcggtttcgggggttacggttccggggacgggtaacgggggaaccctaaagggcctacgggttaacccggttccggtaaacgggttcgaaccgccccggtaagggtcccttccggtacccccgtcgggttaccctaaccggtttcctttccccgg

SEQ ID NO: 343194 - DNA, 603 bp, Homo sapiens
  misc_feature: GZ8MTXP01DFCJG.22.21.B10.1.454.CMB.2.raw
  modified_base (222)..(222): a, c, t, g, unknown or other
  misc_feature (222)..(222): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccngcagtgacgttggtgttacaagtatgtctctggtaccaacaacacccaggcaaacgcccccaaactcatgatttatgagtcactaagcgggcctcgacggggtccctgactcgtcttctctcggcctccgaagtctcggccgaaccaccgggtccctcccgtcgacccgtctcgtcggggctcccgacggctaggacggatggacggctaggtatttatacttgactactcattatgacacgggccgactaacgttcgttgggttcggttcggggtacgggaacgggaccgaaaggtcgttaggacccgttcggtacggtccgacggcccaaacgggtcctaccggtcccctcgggtccaccgttccttccgtttcccccc

SEQ ID NO: 343195 - DNA, 582 bp, Homo sapiens
  misc_feature: GZ8MTXP01ANJY5.22.21.B10.1.454.CMB.2.raw
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctctggtaccaacaccacccaggcacacgcccccaaactcatgatttangaggtcactaagcggcctcgaggggtccctgatcgcttctctcggctcaagtctggacacncggccctcccgtgacccgtctcgtgggcctccgaggctgaggatggaggctgattatactgctactcatatgctaggccgcaacgttcgttggggtcgttcgggcgggtaacgggaaccaacggttcgtacggacccgttccgtaacgggttccgacggccccgaaaggggtcccttaaccggcccccccgttcgggttaccctaacccgtttccgtttcccccgg

SEQ ID NO: 343196 - DNA, 594 bp, Homo sapiens
  misc_feature: GZ8MTXP01CT6IL.22.21.B10.1.454.CMB.2.raw
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccagcagtgacgttggtgttacagtatgtctctgtaccaacaccaccagcacacgccccaaactcatgatttangagtcactaagcggcctcgacggggtcccngactcgcttctctcggctacaagtctcggaccgaccnccggccctcccgtgacccgtctccgtcgggcctccgaggctggacggntggaggtcttagattacttactgtacttactctatagtgacgaggcgactaacgttcgttgggtcggttcgggcgggaacgggtaaccaacggccgtacggacccggttaccgtacggttaccgacggacccgtaacggcccgtaacccgtcccccgtcggttacctaacccgttccgttccccg

SEQ ID NO: 343197 - DNA, 626 bp, Homo sapiens
  misc_feature: GZ8MTXP01EU400.22.21.B10.1.454.CMB.2.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
  modified_base (463)..(463): a, c, t, g, unknown or other
  misc_feature (463)..(463): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatcctcctgcactggaaccngcagtgacgttggtgttacagtatgtctctgaccaacaccaccagcacaccgaccccaaatcatgtatttanggagtcaacgtaacggcggacctcggacggggttccctgacttcgtcttctcgtccggcctacgaagtcgtacggaccgaccgccgtccctcccgtcgacccgttctcggtcgggtccctccgaggcgtggaggagtggtaggtcttagtattattacgtgtacttactntattagtcgacggacggtccgacgtacgttcgggtttggggtcggttaccgggacgggacgggaacctaaggttcgtacggttacccgtacgtacgggttccgaccgacccggaacggtcccgtaaccgcccccgtggttaccctaaccgttcccgttccccg

SEQ ID NO: 343198 - DNA, 645 bp, Homo sapiens
  misc_feature: GZ8MTXP01B70PE.22.21.B10.1.454.CMB.2.raw
  modified_base (524)..(524): a, c, t, g, unknown or other
  misc_feature (524)..(524): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctctgcactggaaccagcagtgacgttggtgttacaagtatgtctctggtaccaacaccacccaggcacacgacccccaaatcatgatttatgagtcactaaggcggcctcgacggggtccctgactcgtcttctctcggcctcgaagtcgtcggaccaacgccggccctccccgtagtacccgtccgtcgtcggggccttcccgaggtcctaggagggtacgtagggaacggtctaggtaacttttagtactcggtaccttaacgttcaatttagtcgacgaggccggactaacgtttcggttgggttcgggtttccgggngggtaacgggaaccgtaaaggccgttacgggaacccgttcggtacgggttaccgacgggacccgtaacgggtcccgtaacccggtcccccgtcggttccctaacgttcccgtttccccggg

SEQ ID NO: 343199 - DNA, 630 bp, Homo sapiens
  misc_feature: GZ8MTXP01A5XYF.22.21.B10.1.454.CMB.2.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (562)..(562): a, c, t, g, unknown or other
  misc_feature (562)..(562): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcaccttcctcactcagggcacagggtcctgggcccagtctgccctgacccagcctgcctccgtgtctggatcatctggacagtcgatcagctatttccngcacgtggaaccaanagtgactagttgggttctttgacttctgtctcctgtaccaacacaccacgacccaaacccccatcatctatttatgtntcactcgtcgcctgagtctctctctatcgtctttccncgaggtcctaccgaacgtctacgggccaaacccgacccggtacccctaccccgtaaacctctccgtcgtcgggtacctccggtagttcggaacggtacgtacgttcttaacttattacgtgtacttagtttaactttaaaggtcggacctccttacgttcgttcggttcgggttcggacggtagtccgtaacgtaacggtcgtaacccgttcgttcggtacncgtaccgacggttcccttcggccccttaaggcctaacctcctaccgttcccctaaccttccgtaaccg

SEQ ID NO: 343200 - DNA, 726 bp, Homo sapiens
  misc_feature: GZ8MTXP01EY2I1.22.21.B10.1.454.CMB.2.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgtacagtntgtctctgacaacaccaccngcacacgaccccaaatcatgtatttangacgtcaacgtacggcggcctcggacgggtccctagactcgtcttctcgtcggcctacgagtcgtacggaccgaccgccggtccctcccgtacgtaccccgttcgtcggtcggggcccttaccggacgggtccgttgggaacgggtagtcgggtaacggtccgttaggttaacttttaacgttaccgtcgtaccttaaccttacgtaaagtttaacggtcggaccggaagggtacccgggtaaccttaaccgtttgggggtttacggggttcgggttaccgggggacgggtaacgggaaccctaaacgggttccgtaccgggttaaccccggttacggtaaaccgggttcccgacgggttacccccgaacggggtccccttcccggtccccccccgggttagggttacccctaacccgtttccccggtttccccccgg

SEQ ID NO: 343201 - DNA, 587 bp, Homo sapiens
  misc_feature: GZ8MTXP01E1A5J.22.21.B10.1.454.CMB.2.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtgttacaagtntgtctctggtaccaacaccaccagcacacgccccaaatcatgatttangagtcactaagcggctcgagggtcccngatcgcttctctcggctcaagtctggcacncggcctcctgaccgtctcgtcgggctccgaggctggagatggagctgattatactgactactcgtaatatcgcgaacggcggtactaacgttcggttggggtcgttccgggacgggaacgggaaccaaacggttccgtacggttaaacccgtccgttaacgggttccgaccggaccccgaacgggtcccgtcccggtcccccgtcggggttacctaacccgttccgtttcccccgg

SEQ ID NO: 343202 - DNA, 583 bp, Homo sapiens
  misc_feature: GZ8MTXP01BC2O7.22.21.B10.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctctgcactggaaccngcagtgacgttggtgttacagtntgtctctgaccacaccaccagcacacgccccaaatcatgatttangaggtcacgtaagcggcctcgacggggtccctgactcgcttctctcggctcaagtctggcgacncggccctccctcgaccgtcgtcgtcgggcctccgaggctggaggacgtggaggtcttagtatttacttactcgtacttactctaatagtcgaccgaggccggtactaacgtttcggttggggtcggttcgggacggtacgggaacacggttcgtcggttacccgtcgtacggttccgacgccccgaagggtccctccggcccccgtcggttacctaaccgttccgttccccgg

SEQ ID NO: 343203 - DNA, 631 bp, Homo sapiens
  misc_feature: GZ8MTXP01D713T.22.21.B10.1.454.CMB.2.raw
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (466)..(466): a, c, t, g, unknown or other
  misc_feature (466)..(466): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagccctccctccgcgtcccgggtctccgtggacagtcagtcaccatctcctgcactggaaccngcagtgacgttggtgttaacagtatcgtctcgtgaccacaccaccagcacacgaccccaaancatntattangagtacacgtaaggcggacctgacgggtcctgatcgtctctcgtcgcctacgaagtcgtcggaacccgacgcccggtccctcccgtacgtacccgttctcggtcgggtccttaccggaggtccgtagggaacggtagtgggaacggtcttaagtagtttaacttaccgngttaccttacttcgtaaagttcgtcgacggacgggccgtacgtacggttcggttggggtcgtcggggacgggacggtaaccgagttccgtacggttaccgtacgtcggaccacggacccgaacggcctcccggtcccccgtggttacctccgttccgttccccgg

SEQ ID NO: 343204 - DNA, 601 bp, Homo sapiens
  misc_feature: GZ8MTXP01EIXXI.22.21.B10.1.454.CMB.2.raw
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttaacaagtntgtctctgtaccaacaccaccagcacacgaccccaatcatgatttangagtcacgtaagcggctcgacgggtccctgatcgctctcgtcggctcaagtctcggaccgacnccggtccctcccgtcgaccgtctcgtcgggtcctaccgaggctaggaggtatggaacggtcttagtaactttattacgtgtacttacctggtaattacgtcgacgacggccggtacctaacgttcggttggggtcggttcggggacgggaagggaacccaaggttccgtacggttaccggtcgttacggccgacggcccgaacgggtcctcccgtcccccgttggccctaaccgttcgttccccg

SEQ ID NO: 343205 - DNA, 614 bp, Homo sapiens
  misc_feature: GZ8MTXP01AIYC5.22.21.B10.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatcctcctgcactggaaccngcagtgacgttggtgttacagtntgtctctgtacaacncaccagcacncgccccaatcatgatttangaggtcactaagcgggcctcgacggggtccctgatcgcttctctcggctcaagtctggccgacgcggccctcccgtgacccgtcgtcgtcgggcctccgaggtctcggaggtagtggacggcttagactttacttaactgtacttactcgtatagtcgacgaggcggtaccaacgttcggttggggttcggttacggggcgggaacgggtaaccaaacgggttccgtacggacccggttacccgtagggttacccgacggaccccgtaaacgggtccctccgggcccccccgttggggttaccccttcccgttcccgtttcccccggg

SEQ ID NO: 343206 - DNA, 613 bp, Homo sapiens
  misc_feature: GZ8MTXP01AZXDK.22.21.B10.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactgaaccngcagtgacgttggtgtacagtntgtctctgtaccaacaccaccagcacacgaccccaaatcatnatttangacgtcacgtagcggctcgacgggtcctgatcgcttctcgtcggctacgaagtctcggaccgacnccggtccctcccgtcggtacccgtctccggtgggtcctccgacggcgtggacggtatggaacggtctaggtactttacgttactcgtacttactactaattagtcgacggacggccgtactaacgtttcggttcggggtacggttcgggaccgggagggaaccaacgttcgtaacgttacccggtacgtacggttccgaccggacccgtaacggtcccgtaacccgtccccgtacggttcctaaccgttccgttccccgg

SEQ ID NO: 343207 - DNA, 605 bp, Homo sapiens
  misc_feature: GZ8MTXP01BOTID.22.21.B10.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
  modified_base (446)..(446): a, c, t, g, unknown or other
  misc_feature (446)..(446): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactgaaccngcagtgacgttggtagtacaagtntgtctctgtaccaacaccaccaggcacacgaccccaaatcatgtatttangagtacacgtaacggcggcctacggacgggttccctgactcgtcttctcgtcgcctacgagtcgtcggaccgaccnccggccctcccgtgacccgtctcggtcgggcctaccgagctaggacggtatgggaggtctagtaagttacttacncgtactacctgtaattagtcgacgacggccgacgtacgttcgggttgggtcgtcggggacggtacgggaacctaggttccgtacggacccgtcggtacggttacgcgacccggaaggtccctcccggtccccgtaggttccctcgttcccgttccccgg

SEQ ID NO: 343208 - DNA, 570 bp, Homo sapiens
  misc_feature: GZ8MTXP01ECSIH.22.21.B10.1.454.CMB.2.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttaacaagtntgtctctgtacacacaccagcacacgaccccaaatcatgatttangagtcactaaagcggcctcgacggggtccctgatcgcttctctcgctcaagtctcggacgaccncggccctccctacgaccgttctcgtgggctccgaggctggagngtagaggtctagtattattactgacttactcgatacgtgcgaggcgactacgttgttgggtcgttcggcgggaaggggaaccctaagggcttacggaacccgttcgtaacgggttccacggttaccccgaaggtcccgtcgacccccgtggttacctaaccgttccgttccccgg

SEQ ID NO: 343209 - DNA, 661 bp, Homo sapiens
  misc_feature: GZ8MTXP01DDZHM.22.21.B10.1.454.CMB.2.raw
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccggtctcctggacagtcagtcaccatctcctgcacgtggaaccagcagtgtacgttggtagttacaagtatgtctctcgtaccaacaccaccagcacacaccccaatcatgtatttagngagtacaacgtaggcggcctacgacgggttcccngtacttcgcttcgcgtccggcctacgtagttccncggaacccgaccgtcccggtcccttcccgtacggtaccccgttccgtcggtcgggccctaccgacggtcgtaggagtgtcgaggtctagtatttatacgtgtcgacgtagggtacgtaaggttaggtaacttaaccgaccgtggtacgttacgtacgtttccgggttaggggtttcgggtgggttaaccggggcgggaaacgggtccgttacggtcggttaccggttacccgttaccggttacggtcgaacccgtaaccgtacggccccgttacccggtccccgttcggtaacccc

SEQ ID NO: 343210 - DNA, 658 bp, Homo sapiens
  misc_feature: GZ8MTXP01B6T8A.22.21.B10.1.454.CMB.2.raw
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgtacaagtntgtctctgtacaacaccaccaggcacacgacccccaaatcatcgtaatttanagtacggtacacgtaaggcgggtcctcgacgggtcccngactcgtctctcgtcgctcgagtctggacgacgccggtccctcccgtcgtacccgtctcgtcgggcctccgaggtcgtaggaggtacgtggtacggtgtacgtagtttacttacgtacggtacttaaccttataacgttagttcggaccggtaacgggccgggtacctacgtttccgggttggggttcggttacggggaacgggacgggtaacccgtaaggttccgtacggttaccccgtacgtacgggttccgaccggttaccccgaacggggtcccgtaacccggcccccgttcgggttaccctccgtttcccgttccccgg

SEQ ID NO: 343211 - DNA, 602 bp, Homo sapiens
  misc_feature: GZ8MTXP01A981Z.22.21.B10.1.454.CMB.2.raw
  modified_base (243)..(243): a, c, t, g, unknown or other
  misc_feature (243)..(243): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctggtaccaacaacaccagcacacgaccccaaatcatgtatttangagtacactaaggcggcctcgacggggtccctgacttcgcttctcgtccgctcagtctggacacncggccctccngacctctcgtgggcctcgagctggacgtagtgaggtctagtatttatacngtactactcgtaattgtacgacgaggccggtaacttaacggtttcggttcggggttcggtacccgggacgggaagggaaccctaaggttccgttacggaccccgttcggtaacggttcccgacggacccccgtaagggtcccctcccgcccccgttaggttaccctccgtttcccgttccccgg

SEQ ID NO: 343212 - DNA, 604 bp, Homo sapiens
  misc_feature: GZ8MTXP01CVN2A.22.21.B10.1.454.CMB.2.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (404)..(404): a, c, t, g, unknown or other
  misc_feature (404)..(404): n is a, c, g, or t
  modified_base (539)..(539): a, c, t, g, unknown or other
  misc_feature (539)..(539): n is a, c, g, or t
tcagacatacgcgtcacgaccggtgctcgatttagtgtcgtcgcaaggggggggtctcaggaggcagcgctctcaagacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccngcagtgacgttggtgttacagtatgtctctgtaccacaccaccagcacacgaccccaaatcatgtatttangagtcacgtaaggcggcctcgacggggtcccngactcgcttctcgtcgcctacagtcgtggcgaccgccggccctcccgtcgccgtctcgtcgggcctcgagctggacgntaggagtctagtattacgttactgtactaactctaatagtgacgaggcgactaacgttcggttagggtcggttaccggggacgggtacgggaacctaacggttcggtaccggacccggtaccgtacgggttaccnccggttacccgaacgggtcccgtcccggtcccccgtcggttaccctcccgttccgtttaaccccg

SEQ ID NO: 343213 - DNA, 559 bp, Homo sapiens
  misc_feature: GZ8MTXP01B89TZ.22.21.B10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
  modified_base (513)..(513): a, c, t, g, unknown or other
  misc_feature (513)..(513): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccngcagtgacgttggtgttacagtntgtctctgtaccaacnccaccagcacacgaccccaaatcatgtatttangagtcacgtagcggctcgagggtcccngactcgtcttcncgtcgctacagtctggaaccacnccggccctccctcgaccgtctcgtcgggcctccgagctggagtcnggtagctagtatttatactgacttactntattacgtgaccgtacggcgtaccacgtttcgggtgggtcggttcggacggggtacgaacgacgcgtacggccgttacaggttcnccggaccaaggtccctccggccccttggcctaacgttctttccccg

SEQ ID NO: 343214 - DNA, 610 bp, Homo sapiens
  misc_feature: GZ8MTXP01EEJIX.22.21.B10.1.454.CMB.2.raw
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (513)..(513): a, c, t, g, unknown or other
  misc_feature (513)..(513): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagctatttcctgctacgtgggaacctaacagtgactagttgggtcttttgactntgtctctgtacaacacaccagaccaacccccatcatctattangtntcactcgtcgcctcaggatctctcatcgtctcncagtcctcctaaacgttcctggaccaaaccgtccggtaccctacccctaaacgcttcctcgtcgggtcctaccgtagtttacgaaggtaacgtacgttacttaacttattaactgtacgttaacggttttaactttaaagttcggtccgtacctacgttcgtcggtttcggtttaccgggngacgtcctacggaagtcgtaccgttcgtcggttcgacgtccgaaggttccttaccgtccccgtcggtcctaccgtcgttccgttccccgccttcccg

SEQ ID NO: 343215 - DNA, 684 bp, Homo sapiens
  misc_feature: GZ8MTXP01B3X2Q.22.21.B10.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctctgcactggaaccngcagtgacgttggtgttacagtntgtctctgtaccaacaccaccaggcacacgacccccaaatcatgtatttangaggtcaacgtaagccggcctcggacgggtccctgactcgtcttcgtcgtcggcctacgaagttccgtaggccgacctccgggtccctcccgtacgtacccgtctcggtcggcctccgaggtctaggacggtagtggaacgtctagtatttacgttactgtccttaactacgtatacgtcgacggtaacgggccgtacgttaaaccgttcggtttcggggtcggtttaccggggccggggtaacgggtaacccgtaaggttacccggttacccgggttacccggttacccggtacgggttaccgacccgggttacccggtaaccgggtccccgttaaccccgggtccccccggttacggttacccgtaacccgtttcccgtttcccccggg

SEQ ID NO: 343216 - DNA, 675 bp, Homo sapiens
  misc_feature: GZ8MTXP01DCOZ7.22.21.B10.1.454.CMB.2.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (364)..(364): a, c, t, g, unknown or other
  misc_feature (364)..(364): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctccgtggacagtcagtcaccatctcctgcactgaaccagcagtgacgttggtagttacagtatgtctctcgtaccaacaccaccaggcacacgaccccaatcatgatttangagtcacgtaaggcggctacgacggggtcccnggtactcgcttcgtctcgcctacagtctggaccgacnccggtccctccgtacgccgtctcgtgggcctccgagtctaggacgtagttacggagggtcttaggtaactttacgttactcgtaaccttaccgttataagtttacgtacggaccggtaacggggtcccgtaacgttaacggtttccgggtttaggggggttcccggtttacgggggacggggttaaaccggggaacctaaacgggttcccgttaccgggacccggtttaccgtacgggttaacccgacggaccccggtaacgggtccctcccggtccccgttcgggaccttcccgttcccgtttcccccgg

SEQ ID NO: 343217 - DNA, 703 bp, Homo sapiens
  misc_feature: GZ8MTXP01CHK9S.22.21.B10.1.454.CMB.2.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcacgcctccctccgcgtccggtctccgtggacagtcagtcaccntctccngcactggaaccngcagtgacgttggtgttacagtntcgtctccgtgtaccaacaacaccgagacaacgccccaaatcatcgtatttanagacgtacacgtaacgccggaccctagacgggggtcccctggacttcgtctttacgtctcggccccttaccaagtcgtacggaccaaacccgtaccggtccctacccgtcgtacccgtctccgtcgggtacctccgaggtctaggacgagtacggaggtcttaggtaatttacgttacgcgacgtacgtaccttaagtaacgttaggtacgggacggacgtacggtaaccgtaacgtttagggtttcgggttacggggtaccgggacggggtaacggtaaaccggaacggttcgttaaccgggttacccgttaaccggtacggttacccgaccggttacccggtaaccggtcccgtccccggttaccccggtaccggttaccctaaccccggtttcccgttccccg

SEQ ID NO: 343218 - DNA, 554 bp, Homo sapiens
  misc_feature: GZ8MTXP01B0357.22.21.B10.1.454.CMB.2.raw
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (515)..(515): a, c, t, g, unknown or other
  misc_feature (515)..(515): n is a, c, g, or t
  modified_base (544)..(544): a, c, t, g, unknown or other
  misc_feature (544)..(544): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacaagtntgtctctgtaccaacaccaccaggcacacgacccccaaactcatgtatttangagtcactaagcggcctcgacgggtcctgactcgcttctctcggctcagtctggcacncgcctccctgaccgtctcgcgggctccgaggctggaggatggacggtcttagtatttactactgcttacgtcagttatcgcgtacgggcgtactaacgttcggttggggttcggttacgggcgggaacgggtaacaagttcgtcggaccgtcgtaggttccncgacccgaaggcctcgtccccgtggttcnccttcgtccc

SEQ ID NO: 343219 - DNA, 652 bp, Homo sapiens
  misc_feature: GZ8MTXP01ET0XG.22.21.B10.1.454.CMB.2.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatcctcctgcactcggaaccngcagtgcgttggtaggttacaagtntgtctctcgtaccaacaccaccagacaccacgacccccaaactcatgtatttangagtcacgtaagcggcctcgacgggtccngatcgcttctcgtcggcctacgagtcgtcggaaccacgtcccggccctcccgtcgacccgtcgtcgtcgggcctcgaggtctagggagtacgtaggaggtcgttaagtactttaactacgttctaccttacttactaagtagtcgacgtgggccgtactaacgttcggtttggggtcgggttaccggacggggaacggaacctaaacgggttccgttacggggaccccgtttcgggtaacggttacccgaccggaccccgggtaaggtccccgtccccgggtcccccgtcggttaaccctcccgtttcccggttcccccggg

SEQ ID NO: 343220 - DNA, 569 bp, Homo sapiens
  misc_feature: GZ8MTXP01BAYPH.22.21.B10.1.454.CMB.2.raw
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
  modified_base (416)..(416): a, c, t, g, unknown or other
  misc_feature (416)..(416): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatctctgcactggaaccagcagtgacgttggtagttacaagttatgtcctctggtaccaacaccacccaggcacacgccccaaatcatcgatttangaagtcactaagcgggtcctcgacggggtccctggactcgcttctctcggctcaagtctggcaacncggcctacctgtacccgtctccgtggggcctccgagcgtagacggatgaccggtntagtacttatactcactactcgtattagtcgacgacggcgtacgtacgttcggttggtcggtcgggacggacggaactaacggcgtacggaccgtacgtacgttacgcggaccgaacggtccgtccgtcccgtcgttactccgttccgtcccg

SEQ ID NO: 343221 - DNA, 655 bp, Homo sapiens
  misc_feature: GZ8MTXP01BZPGZ.22.21.B10.1.454.CMB.2.raw
  modified_base (292)..(292): a, c, t, g, unknown or other
  misc_feature (292)..(292): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccagcagtgacgttggtgttacagtatgtctctgtaccacaccaccagcacacgaccccaaatcatgtatttangagtcacgtagcggtctcgacggggtcctgactcgtcttcgtcgtccggtcctacgaagtccgtggaacccgacgtcccggtccctacccgtcgtacccgtctcggtcgggccctcgagtcgtggagtagtggacggtctaggtatttacttacgtcgtactaactactagttagtcgacgtacgggccgtacgttaacggtttcggtttacggggttcgggttaccggggacgggtaacggggaaccgtaacgggttccgttacggttacccggttaccgtacgggttaccgaccggttaccccggtaacggtcccgtcccggtcccccggttcggttccctaaccgttcccgtttccccgg

SEQ ID NO: 343222 - DNA, 595 bp, Homo sapiens
  misc_feature: GZ8MTXP01BM2NC.22.21.B10.1.454.CMB.2.raw
  modified_base (220)..(220): a, c, t, g, unknown or other
  misc_feature (220)..(220): n is a, c, g, or t
  modified_base (295)..(295): a, c, t, g, unknown or other
  misc_feature (295)..(295): n is a, c, g, or t
  modified_base (370)..(370): a, c, t, g, unknown or other
  misc_feature (370)..(370): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatcctctgcactggaaccngcagtgacgttggtgttacaagtatgtctctgtaccaacaccaccagcacacgaccccaaactcatgtatttagngagtcacgtaaggcggtcctcgacggggtccctgactcgtcttcgtcgtcggcctacaagtcgtcggaccgaccnccggccctacccgtcgacccgtctcggtcgggcctaccgaggtctaggaggagtggaacggtcttagtaactttattacgtcgtacttactcgtattagtcgcgaggccgtacgtacgttcggttgggtcggttcgggcgggacggaacacggcgtcggaccgttcgtagttccgccgccgaacgtccgtcccgtccccgtcggttaccgtccgttcgttccccg

SEQ ID NO: 343223 - DNA, 574 bp, Homo sapiens
  misc_feature: GZ8MTXP01C7B8N.22.21.B10.1.454.CMB.2.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
tcagacatacgcgtcacgaccggtgctcgatttagtgtcgtcgcaagggggggtctcaggaggcagcgctctcaggacgtcaccaccatggcctgggctctgctcctctcagcctcctcactcagggcacagggtcctgggcccagtctgccctgactcagccctccctccgcgtccgggtctcctggacagtcagtcacntctccngcactggaaccngcagtgacgttggtgttacagtntgtctctgtacacaccaccaggcacacgaccccaaatcatgtatttangaggttacacgtaagccgggcctcgacgggttcccngatcgcttnctcgctcagtcngacacncgctcccngccgtntcngggctcgagctgagatgaggtctagtattacgttaatgtactactacgtaattagtcgaccgtaggcccggtactaacgttcggttgggtaggttccgggacgggacggtaaccgaaggttccgttacggacccgttacgtggttaccgacgacccgtaaggtcccgtccgtcccccgtggttaccctaaccgttcgttccccg

SEQ ID NO: 343224 - DNA, 635 bp, Homo sapiens
  misc_feature: GZ8MTXP01B5YXQ.22.21.B10.1.454.CMB.2.raw
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttacagtntgtctctgtaccaacaccaccaggcacacgacccccaaatcatgatttagngaggtcacgtaagcggcctcgacggggtccctgatcgcttctcgtcggcctcagtctggcgacncggccctccctgaccgtctcgtgggcctccgagctgaggatggacggtcttagtatttacgttactgtaccttacgtcgtaattagtcgccgtaagggcccggtacgtaaccgttcggtttacgggggttcggtttcgggggccgggaacggggtaacccaaggttcccgttaccgggacccgttacccggtaacgggttccgttaccggaacccccgaacgggtcctcccggtaccccccgttcggggttaccctaaccgtttccccgtttccccgg

SEQ ID NO: 343225 - DNA, 597 bp, Homo sapiens
  misc_feature: GZ8MTXP01AV01O.22.21.B10.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctcgcgtccggtctcctggacagtcagtcaccatctcctgcactggaaccagcagtgacgttggtgttacagtntgtcnctggtaccaacaccaccaggcacacgccccaatcatgatttangtagtcagtagcggctcgacgggtccctgactcgcttctctcggctcaagtctggacgacncggcctcccgtgtacccgtctcgtcgggtccctacccgaggtccgtggacgggtagtcggtaggtaccgtagttaacgttaacgttactcggtacttacctcggttaataagttcgcgtacggtcggacttaacgttccggtttgggtacgggttcgggtacggaggggaacctaacggccgtacgaccggtcgttacgcgttcgaccgaacgcgtcgaccccgtgttccgtaacttccgttcccg

SEQ ID NO: 343226 - DNA, 570 bp, Homo sapiens
  misc_feature: GZ8MTXP01D9D4F.22.21.B10.1.454.CMB.2.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactgaaccagcagtgtacgttggtagttaacaagttatgtctctagtaccaacgaccaccaggcacacgacccccaaatcatagtatttangagtcactaaggcggctcgacgggtcctagactcgcttctcgtacggcctacaagtcgtacggaccgaaccnccggccctcccgtcgtaccgtctcgcgggtacctccgagcngagactgacggtntatatatctntactactgtatagtcgacgacgcgtactagttcggtggtcggtcggacggacggaactacggcgtacgttaccgtcgtacgccgccgaccgaacgtcccgtcccgtcccgtacgttacctccgttccgtcccg

SEQ ID NO: 343227 - DNA, 585 bp, Homo sapiens
  misc_feature: GZ8MTXP01C7PP0.22.21.B10.1.454.CMB.2.raw
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccagcagtgacgttggtaggttacaagtatgtctctgtaccaacaccaccagcacacgaccccaatcatgtatttangagtcactaaggcggcctcgacgggtccctgactccgtcttctcgtcggcctaccgagtcctcggaccgacgccggccctcccgtcgacccgtctcgtcgggcctcgaggctggacgtntgaggtctagtattacttacgtgtacttactacgtattagtcgacgaggccgtactacgttcggttggggtcgttcgggcggaacgggtaaccaagttcgtcggaccgttcgtacggttcgacggcccgaaggtccctccggcccctcggttcctaaccgttcgttccccg

SEQ ID NO: 343228 - DNA, 618 bp, Homo sapiens
  misc_feature: GZ8MTXP01DXHXJ.22.21.B10.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatcctcctgcactggaaccngcagtgacgttggtgttacaagtncgtctctgtaccacaccaccagcacacaccccaatcatcgtatttangagtcacgtaacgcggcctggacgggtcccngtactcgtcttctcgtcggcctacgagtcctcggaaccaccgtaacccggcccttccccgtacgtacccgttcgtccggtcggggcccttacccgagggccgtagggaacgtgtaggaaggtccgtagtatttaacgttaactgtaccttatcaattagtcgacgacggcgcttaacgtgtttcgggtcgttcgggacgggtaggaaccaaggttcgtacggttaccgtaccgtcggttccgacgttcccgaacggctccccgtcccctcggttcctaaccgttcccgttccccg

SEQ ID NO: 343229 - DNA, 571 bp, Homo sapiens
  misc_feature: GZ8MTXP01B1D4F.22.21.B10.1.454.CMB.2.raw
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgtacgttggtgtacagtatgtctctgtaccaacaccaccagcacacgaccccaaatcatgtatttangagtcaacgtagcggctcgacgggtccngatcgtcttctcgtcgtcctacgtagtcgtggaccgaccnccggtccctcccgtcgaccgtctcgtcgggctcgagctagaggntggagtctagtattattctgtactacntatacgtcgacgnggccgtactacgttcggttagggtcggttcgggcgggtaacggaacgacgttcgccgttaccgtcgtacgttaccgcgacccgtaacgctaaccccgtcccctggttaccctcgttcccgttcccc

SEQ ID NO: 343230 - DNA, 691 bp, Homo sapiens
  misc_feature: GZ8MTXP01A4WZS.22.21.B10.1.454.CMB.2.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctgccctgactcagccctccctccgcgtccggtctcctggacagtcagtcaccatctcctgcacgtggaaccngcagtgacgttggtgtacagtntgtctctgaccacacaccagcacacgaccccaatcatgtatttangacggtacacgtaacgccgcctcgtacgggtccctgactccgtacctttcgtaccgtcggtacctacgtaacgtcgacggtaacccaaaccgcccggtcccttccccggtacgtaccccgttctccggtcggggccttacccggagggtccgtagggacgggtagttacggaacggggtccttaggtaactttaacgttacgtctacgtaacgtcgttacctaaggttacgtacgggacggcgtaacggtacgtaacgtttaacggtttgggtaccgggttacgggacgggtaaccgggaaacttacggtacgttaccggtacccggtacgttacgggttccacccgtaacccggtacgccgtccccggtccccgttacgttccgttaaccgtttccccgg

SEQ ID NO: 343231 - DNA, 614 bp, Homo sapiens
  misc_feature: GZ8MTXP01D5HL8.22.21.B10.1.454.CMB.2.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (578)..(578): a, c, t, g, unknown or other
  misc_feature (578)..(578): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctccgtggacagtcagtcaccatctccngcactggaaccngcagtgacgttggtagtacaagtntgtctctgtaccacaccaccagcacacgacccaaatcatgtattangagtacacgtaagcggctcgacgggtccctagactcgtcttcgcgtcgcctacgtaagtcgtcggaacccgtaacgccggtccctcccgtacgtacccgtcgtcggtcgggtccctaccggagtcgtaggaggtacgtggacgtcttagtaattactacgttctacttacttacgtaattagcgacggtacggaccgtactacgtttcgggttgggtcggttaccgggacgggtaacgggaacacgggcgtcgttaccgtacgtagaccgacgaccgaacggtccnccgtaccccgtcgttacctaaccgttccttaacccg

SEQ ID NO: 343232 - DNA, 628 bp, Homo sapiens
  misc_feature: GZ8MTXP01APVB3.22.21.B10.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctctgcactggaaccngcagtgacgttgtagttataactntgtctctgtaccaacacaccagacaaacgcccaaatcatgtatttagagacgtacactaaggcggtcctcggacggggtccctgactcgcttcgtcgtggaccccttccgaagttccgacgggacctaaacccgacccgggtccccttacccgtacgggtaccccgttctccggtggggcctaccgagtcgtaggagatggagtacttagtatttacgtactgtacttactataatagtcgacgacggccgtacgtaaccgttggttaggggtcgtccggggacgggacggaaccgaaggtcgttacgggtacccttcggttacggacaccggcaaccgggtcctacccggtccccgtggacttcccgtcgttcccgtcccccg

SEQ ID NO: 343233 - DNA, 583 bp, Homo sapiens
  misc_feature: GZ8MTXP01EVP72.22.21.B10.1.454.CMB.2.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgtacgttggtagttacagtatgtctctgtaccaacaccaccagcacacgaccccaaatcatgtatttangtaggtacacgtaagcggtcctcgacgggtccctgactcgtcttcnctcggctcgagtctcggcacgcgtcctccngccgtctcgcggctcgngctgagatgagctgtattatactgtctaatcgtaatgtagcgtaggccgactaacgttcggttcggggtaggttaccgggcggggtaacgggaacctacggttacgtcggttacccgtcgtaagggttccgaccggttcccgtaacggcccgttaaccgcccccggttgttaccgtaaccgtttcccgttccccg

SEQ ID NO: 343234 - DNA, 711 bp, Homo sapiens
  misc_feature: GZ8MTXP01A4CBH.22.21.B10.1.454.CMB.2.raw
  modified_base (262)..(262): a, c, t, g, unknown or other
  misc_feature (262)..(262): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacgagggtcctgggcccagtctgccctgactcacgccctccctccgcggtccggtctccgtggacagtcagtccaccatcctcctgccacgtacggaaccagcaggtgtacggttgggtagttaacaagtntcgtcctcgtacggtaacccaacacccaccgagccacaccgaccccaatcatgtatttagngagtcaacgtacggcggtcctcggaccgggttccngactccgtcttctcgtccggcctacgagtcgcggaccaaccgccggtccctcccgtacgtcccgtcgtcggtcgggcctaccgagggtcgtagggacggtagtacggacgttcgttaagtaacttttaacgttacgtcgttaaccttacgtactaagttacggccggaacggtaccggccgtaaccgttacggtttcggggtttacgggggtcgggttaaccgggacggggaaaccggtaacaacgggttccggtaaccggttacccggttaccgggtacgaccggaccggttaacccggccgggtccctccccggtcccgtcggttaccctccgtttccccggttcccccgg

SEQ ID NO: 343235 - DNA, 587 bp, Homo sapiens
  misc_feature: GZ8MTXP01EE4IE.22.21.B10.1.454.CMB.2.raw
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (448)..(448): a, c, t, g, unknown or other
  misc_feature (448)..(448): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaaccagcagtgacgttggtgtacaagtntgtctctagtaccaacaccaccngcacacgacccaatcatgtattangagtcacgtagcggctgacgggtcctgatctctctcgtcgctacgagtctcggaccacgccggccctcccgtcgtacccgtctcggcgggtcctccgaggtcgtaggagtagtaggtacggtcttaagtaatttaacttacgtcgtacttaactntaagtacgtcgcgaaggccgtaactacggtttgggttagggtcgggtacggacgggaagggaacctaaggttcgtaccggttccgtcgtacggcgttacgaccgaagtccgtccgtccccgtgttctccttcgtccccg

SEQ ID NO: 343236 - DNA, 603 bp, Homo sapiens
  misc_feature: GZ8MTXP01EYRY8.22.21.B10.1.454.CMB.2.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgtacgttggtagtaacagtntgtctctgacaacnccaccagcacacgaccccaaatcatgtattangacgtacaacgtaagcggtcctcgacgggtcctgactcgtcttctcgtcggcctacgaagtcgtcggaccaccgccggtccctcccgtacgtcccgtctcggtcgggcctccgaggtcgtaggaggtacgtggtacgtcgttagtatttacgttacgtcgtacttactactagttacgtcgacgacggcgtacgtacgttcggttgggtcggtcgggacgggacggaacgtacggcgtacggttacccgtcgtacgcgttccggaccgaacggtcctccggccccgtgttacctaacgttcccgttcccg

SEQ ID NO: 343237 - DNA, 728 bp, Homo sapiens
  misc_feature: GZ8MTXP01D1TS2.22.21.B10.1.454.CMB.2.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtcccgggtctccgtggacagtcagtcaccntctcctgcactgaaccngcagtgtacgttggtagtacagtntcgtctctgaccacaccaccagcacaccaaccccaatcatgtatttanggagtcacgtaagccggtcctcggacgggtcctggtactcgtcttactcgtcggtacctaccgagtccgtcggaacccaaccgtcccggtccctaccccgtcggtaccccgttcgttcggtcgggtccctaccggaggtccgtaggacgggtacgtggaaccggtgttaacgttagttaacgttaccctaggtaccttaaccttaggtaacttaggtcggaccggaacggggtccgtaaccggttaacgtttcggggtttcggggttccggggtttacggggaccgggggaacggtaaaccggaacggttccgtaccggttaccccggttaccgtaacgggttccgacccggttaccccgggtaaccgggtccccgttccccgggttcccccccggtacggttacccttccccggtttcgtttaaccccccgg

SEQ ID NO: 343238 - DNA, 605 bp, Homo sapiens
  misc_feature: GZ8MTXP01CRIOQ.22.21.B10.1.454.CMB.2.raw
  modified_base (222)..(222): a, c, t, g, unknown or other
  misc_feature (222)..(222): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtgtaacagtatgtctctgtacaacaccaccagcacacgaccccaatcatgtatttatagtcacgtaagccggctcgacgggtccctgacttcgcttctcgtcgtcccctaccgaagtcgtcggccgaaccgaccggtccctcccgtcgtacccgttccgtcgtcggggcctcgaggtctaggacggatcggaggtcttagtatttactacgtgtactactcagtacgtcggacgacgggtcgactaacgttcgttaggggcgttcgggacggtacggaccaaggtcgttcggtacccgttcgtaacggcaccggttccgaacggccgtacccgccccgttcggtccttaccttccgttcccgttcccccg

SEQ ID NO: 343239 - DNA, 804 bp, Homo sapiens
  misc_feature: GZ8MTXP01DM2NK.22.21.B10.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctcctcgcgtccggtctccgtggacagtcagtcaccatctctgcactggaaccngcagtgacgttggtgttaacagtntgtctctgtaccaacaccaccagcacacgaccccaaatcatgtatttagngacggtcacgtaaggccggtcctcggacggggttccctgacttccggtcttcgtaccgttcggccttaccggaaggttcccgtacggggaacccgaaccgcccgggtccctacccccgttacgggtaccccgttccgtcggtcggggtcccttacccgaagggtccgtagggaacgggtagttacgggaacgggtcctttaaggttaacttttaacgttaccgttcggtaacctttaaccgttaccgtaagttacggtaccggaccggtaacggggaccgggttaccttaaaccggtttcggggtttcgggggttacgggttccgggggaacggggttaacccggggaaaacccgtcgggttccgggttaacccggttaaaccccgggttttcccggtaacgggggttaccccaaccggggttacccccggtaaaggttcccccggttccccgggttccccccccgttaacggggttccccttaaccccggttccccgggttttaaccccccg

SEQ ID NO: 343240 - DNA, 619 bp, Homo sapiens
  misc_feature: GZ8MTXP01ARFDU.22.21.B10.1.454.CMB.2.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctccgtggacagtcagtcaccatctcctgcactggaaccngcagtgacgttggtgtacaagtntgtctctgtaccaacaccaccgagcacacgaccccaaatcatgtatttagnggacgtcacgtaaggcggtcctcgacgggtcctaggactcgtcttctcgtcggtcctacgagtcgtcggaccgaccgccggtccctccgcgtacccgtctcggtcggcctccgagtcgtagaggagtggacggtccgtattacgttactacgtactacgtacaacgtgtcgtacgacggtaccgtacgtaacgttcggttaggggttcgtcggggacggacggacgaacggtcgttacggtacccttcggtacgtacgaccggttccccgacggtcccgtcccgccccgttacgtccttaccgttccgttcccgttcccccg

SEQ ID NO: 343241 - DNA, 720 bp, Homo sapiens
  misc_feature: GZ8MTXP01AUSV2.22.21.B10.1.454.CMB.2.raw
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcacgccctccctccgcgtccggtctcctggacagtcagtcaccatcctcctgcactcggaaccagcagtgacgttggtagttacagtntgtctctgaccacaccaccagcacacgaccccaancatgtatttangagtcaacgtaacggccggtcctacggacgggtccctagtactccgtcttctcgtccggtctacgagtcgcggaccaccgtccgccctccgtacgtaccgtcgtcgtcgggcctaccgggngtcgtaggacggtagtacggtacggtacttagttaatttacgttacgtacgttaccttacgttacgtaacgttacggtaccggacggtacggtaccgtacgttaaccgggtttcggggtttacgggggttcccgggtaacgggggaaccggggtaacgggtaacccgtaacggttacccgggtacccggttacccggttaacccgggtaacgggttacccgacccggttaccccggtaaccggtccccgttccccgggtacccccgttacggttaccccttaacccgttccccgttaacccccg

SEQ ID NO: 343242 - DNA, 685 bp, Homo sapiens
  misc_feature: GZ8MTXP01C1HB4.22.21.B10.1.454.CMB.2.raw
  modified_base (215)..(215): a, c, t, g, unknown or other
  misc_feature (215)..(215): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcacgccctccctccggcgtccggtctccgtggacagtcagtcaccatcctccngcacgtaggaaccagcagtgacgttggtagttacagtatcgtctctggtaccacaccacccaggcacacgaccccaaatcatnatttngagtacacgtaaggcggcctgacgggttccngacgtcgtcttctcgtcggcctacgtagtccgtggaccggaccnccgggtccctacccgtcggtaccgtcgtcggtcgggcctccgagggtccgtaggacggtgtagggagtccgttagttaactttattacgtacgtacctttaacgtcctaaagttcgtacgggaccgacggggcccgttaaccgtaacggtttcggtttacggggttcggttaccggggcggggtaaacggtaaccgaacggttcgttaccgggttaccggttacccgtggttacccgaccgaccccggtaacggccccgtcccgtcccccggttccggttacccttaacccgttccggtttcccccg

SEQ ID NO: 343243 - DNA, 726 bp, Homo sapiens
  misc_feature: GZ8MTXP01D022V.22.21.B10.1.454.CMB.2.raw
  modified_base (318)..(318): a, c, t, g, unknown or other
  misc_feature (318)..(318): n is a, c, g, or t
  modified_base (544)..(544): a, c, t, g, unknown or other
  misc_feature (544)..(544): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccggtctccgtggacagtcagtcaccatcctctgcacgtgaaccagcagtgtacgttggtagttaacagtatcgtcctccgtacggtaaccaaccgacccaacccgaggcacaccgaccccctaaactcatgtaatttagnggtaacgtcaacgtaacggccgggtccttacggtaccgggggttcccctaggtacgttccgtcctttcgtccgtacggccttaccgaagttccgtcgggaacccgaacccgaacccgggtccccttcccgtacggtaccccgttcgtcgggtcgggtccctccgagggtccgtagggacggtagtggtacggtgttagtaactttacttaacgtctactaccttanaacgttagtcgacgaggtccgacgtaacggtttcggttggggtccggttaccggggcgggtaacgggaaccgtaacgggttccggttaccggttacccgggttacccgtacgggttaccgaccggacccggtaacgtcccgtcccgtccccgtcggttaccctaaccgttccgtttcccccg

SEQ ID NO: 343244 - DNA, 712 bp, Homo sapiens
  misc_feature: GZ8MTXP01CQUBK.22.21.B10.1.454.CMB.2.raw
  modified_base (303)..(303): a, c, t, g, unknown or other
  misc_feature (303)..(303): n is a, c, g, or t
  modified_base (355)..(355): a, c, t, g, unknown or other
  misc_feature (355)..(355): n is a, c, g, or t
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
  modified_base (617)..(617): a, c, t, g, unknown or other
  misc_feature (617)..(617): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtcccgggtctcctggacagtcagtcaccatcctcctgcacgtgaaccagcagtgtacgttggtagttacagtatgtctcgtaggtaccaacgaccaccagcacgaccgaccccaatcatgtatttgnggacgtacaacgtacggccggtcctacggacgggtccctgactcgtctttcncgtcggcctacgtagtccgtcggaaccgtaccgccggtcccctccccgtaggtacccgtcgttccggtcgggacctaccggtaggccgtaggagggtntgggagtcttagtaatttcgtactntacttacgcgtaatttacggcgacggtacgggtaccgtaaccgtttacgttccggggttttaggggtaccgggttaccggggacggggaacggtaacccgtaagggttcccggttacccggttaccggtttaacccggngggttaccccgaaccggaccccggttaaggccccgtttcccccggaccccggtttacggttcccttaacccccgtttcccggtttaaaccccccg

SEQ ID NO: 343245 - DNA, 609 bp, Homo sapiens
  misc_feature: GZ8MTXP01EL3QU.22.21.B10.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (364)..(364): a, c, t, g, unknown or other
  misc_feature (364)..(364): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtagttacaagtntgtctctggtaccaacaccacccagcacacgaccccaaatcatgatttangagtcactaagcggacctcgacggggtccctgactcgcttctctcggcctacaagtctcggacgaccnccggtccctcccgtcgacccgtcgtcgtcgggtaccttccgaggcctaggaggtactggaaggtcttaggtaatttattacgtgtacttacttctaattacgttgcgaaggccggactaacgttcggttggggtcggttcgggacgggtacgggaaccaaggttcgtcggttacccgtcgttacggcgacgttcccgaaggtcctaacccggccccgttggttaccctccgttccgttccccggg

SEQ ID NO: 343246 - DNA, 583 bp, Homo sapiens
  misc_feature: GZ8MTXP01B2H9C.22.21.B10.1.454.CMB.2.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (552)..(552): a, c, t, g, unknown or other
  misc_feature (552)..(552): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctcgccctgactcacgcctccctccgcgtccgggtctcctggacagtcagtcaccatctcctgcactggaaccagcagtgtacgttgtagtacagtntgtctctagtaccaacaccaccagcacaccaccccaatcatntatttagngagtcaacgtaggcggtcctaggaccgggtcctgtactcgtcttctcgtcgcctacgagtctggacccgacncccggtccctcccgtcggtacccgtccgtacggtcgggtaccctccgagcgtaggacggtagtacggaggtacttagtatttactactcgtacttactctaatcgtacgacgtacggccgtacgtacgttgggtcggttcgggtcggacgggacgaacgagcgtacgcgtacgtgcgcgccgngcctccgtccgtcgttactcgttccgtcccg

SEQ ID NO: 343247 - DNA, 698 bp, Homo sapiens
  misc_feature: GZ8MTXP01DXG9V.22.21.B10.1.454.CMB.2.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagccctcctcactcagggcacagggtcctgggcccagtctcgccctgactcacgccctccctccggcgtccggtctccgtggacagtcagtcaccntcncctgcactggaaccngctagtgtacgttggtagtacagtntgtcnctagtacaacaccaccgagcacaccgacccctaaatcatacgtatttagacgacgtacaacggtaacggccgggtacccgttacggaacccgggggttccttacgacgttccgtaccgttcctcggtaccggtcccttaaccgaaaggttcccgtaccggggaaccgacccgtaacccgggtcccctacccgttacgggtaccccgttccgtcggtacggggtccttacggacgtcgtaggaggagtaggacgtcgttagtaagttactactctacttactataacgtgtacgcgtaaggccgtactacggttcgttcggggttgtccggggaacggacgggtaacctaacggttcggaccgttaccgtccggtaacggaccgacgacccgtaaggtccctaacccggtcccctcggttcctaaccgttccgttaaccccgg

SEQ ID NO: 343248 - DNA, 675 bp, Homo sapiens
  misc_feature: GZ8MTXP01C8Q6L.22.21.B10.1.454.CMB.2.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccggtctccgtggacagtcacgtcaccatcctccngccactggaaccngacgacgtgtacggttgggtacggttaacaaggttntcgtctccgtaggtaccaacaccacagacaccacgccccaaatcatntattntagagtcacgagcggctgcgggtcngctcgtctncgtcactcgatcgngaacacncgtcctcctcgacgtcgcgtcgactcgnggcgtcgagggttacggacgttctaattacgttaaccttacgtcgtaccttaacctagggtaaacgttgttaccgggaccggggttacggaaccccggttaccgtaacggttttcccggggttaagggggttccggggttacccgggggacgggttaacccgggaaaccgtacggttacccggtaccggaaacccgttccgggtagttaccccgaacggttcccgtaacgccccgttccgtaccccgtacggttcccttaacgttcccggtttcccccg

SEQ ID NO: 343249 - DNA, 602 bp, Homo sapiens
  misc_feature: GZ8MTXP01DRO5G.22.21.B10.1.454.CMB.2.raw
  modified_base (300)..(300): a, c, t, g, unknown or other
  misc_feature (300)..(300): n is a, c, g, or t
  modified_base (366)..(366): a, c, t, g, unknown or other
  misc_feature (366)..(366): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccggtctccgtggacagtcagtcaccatctcctgcactaggaaccagcagtgtacgttggtggttaacagtatgtctctcggtacacaccaccagcacacgaccccaactcatgtaattacgngtacgtacactaagcggctcgacgggtccctgatcgtctctctcgctacaacgtcgtcgaacgacnccggcctcccgtacgtaccgtctcgtcgggactcgaggtctggaaggtcttaggaggtactggttaacttaacgtacgtacgtactacgtacgtaaagttcgtcgtcgaaggccgtacgtaacgttcgttggggtcgtaacgggcggaggtaacacgttcgtacgaccgttcgagttccgacggcccgtaacggcgtccgtaccccgtcggttacctaaccgttcccgtttccccg

SEQ ID NO: 343250 - DNA, 556 bp, Homo sapiens
  misc_feature: GZ8MTXP02IJSUH.22.21.B10.1.454.CMB.2.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
  modified_base (419)..(419): a, c, t, g, unknown or other
  misc_feature (419)..(419): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctggtaccaacaccacccaggcacagcccccaaactcatgatttangaggtcactaagcgggcctcaggggtccctgatcgcttctctggctccaagtctggcgacncgggcctccctgacccgtctcgtcggggctcccgaggcctgaggatgaggctgatttatacngctactcatatgacaggcgacaacttcgttaggggtgtttacggggcggagggaacccaaggccgtacggtacccgttcctaggggtaccacggaccccaagggcctcggccccctggtcctaccgtctttccccgg

SEQ ID NO: 343251 - DNA, 522 bp, Homo sapiens
  misc_feature: GZ8MTXP02JHDO9.22.21.B10.1.454.CMB.2.raw
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctcctggtaccaacaccaccaggcacagcccccaaatcatgatttangaggtcactaagcggcctcaggggtccctgatcgcttctctcggctccaagtctggcgacncggcctccctgaccgtctcgtgggctccaggctgagatgagctgattatactgctactcatatgcaggcggcaacgtcgttggggtgtttcgggcggaggggaccaaggctcggaccgtcctagggtcagccccgaaaggcctcgcccccgtcggtccactcgttcccg

SEQ ID NO: 343252 - DNA, 533 bp, Homo sapiens
  misc_feature: GZ8MTXP02GLDBA.22.21.B10.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggngttacagtntgtctctggtaccaacaccacccaggcacacgcccccaaactcatgatttangaggtcactaagcgggcctcgaggggtccctgatcgcttctctggctccaagtctggcacnccggcctcctgaccgtctcgtgggcctcccaggctgaggatgaggctgattatactgctactcatatgcaggcggcaacgtcgttgggtgttcgggcggacgggaccaaggcgtacggaccgtccgtacgggtcacgccccgaaggcctcgcccccgtcggtccaccgtcgttcccg

SEQ ID NO: 343253 - DNA, 504 bp, Homo sapiens
  misc_feature: GZ8MTXP02JCXMA.22.21.B10.1.454.CMB.2.raw
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctggtaccaacaccaccaggcacacgcccccaaactcatgatttangagtcactaagcggcctcgaggggtccctgactcgcttctctcgctccaagtctggcgacncggcctccctgaccgtctctgggctccaggctgaggatgagctgattatactgctactcatatgcagcgcaactcgtggtgttcggcggaggaccagctcgaccgtctagggtcacgcccgaaggcctcgccccctggtccacgtctccg

SEQ ID NO: 343254 - DNA, 596 bp, Homo sapiens
  misc_feature: GZ8MTXP02G4JX4.22.21.B10.1.454.CMB.2.raw
  modified_base (297)..(297): a, c, t, g, unknown or other
  misc_feature (297)..(297): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccacccaggcacacgcccccaaactcatgatttangagtcactaagcggcctcgacggggtccctgactcgcttctctcggctccaagtctggcgtacgccggcctccctcgacccgtctcgtcgggccctccgaggcctgaacggatggaggtctaggtaattacttactgtactacttcaattagtcgacgaggccgacgtaacttcggtttggggtggttccgggacgggaacgggaccgtaaggtccgtacggaccggttaccgtaggtaccgaacggcccgaaaggccctaccggcccccgttcgggtaccctaccgttcctttccccg

SEQ ID NO: 343255 - DNA, 553 bp, Homo sapiens
  misc_feature: GZ8MTXP02JPG64.22.21.B10.1.454.CMB.2.raw
  modified_base (294)..(294): a, c, t, g, unknown or other
  misc_feature (294)..(294): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctctggtaccaacacaccaggcaaacgcccccaaatcatgatttangagtcactaagcgcctcgaggggtccctgatcgcttctcgtgcctccaagtctggcaacgacggcctccctgaccgtctcgtgggcctccgagctggagatggagctgatttatactgcagctcatagtggagcagcgactaagtttgggtagttcgggacgggacggggacaaggtccgtacggacccgttcgtacggtaccgacgccccgaaaggccctaccgtccccccgtggtaccctaccgttcctttccccgg

SEQ ID NO: 343256 - DNA, 649 bp, Homo sapiens
  misc_feature: GZ8MTXP02H2ZC5.22.21.B10.1.454.CMB.2.raw
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaagggggggtctcaggaggcagcgctctcgggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccagcagtgacgttggngttacaagtntgctctggtaccaacaccaccaggcacacgacccccaaactcatgatttangaggtcactaaggcggcctcgacggggtccctgatcgtcttctctggtccctaccaagtcgtggcgacgacggtccctcccgtcgacccgttctcctcggggccttccgacgcctggacggagttggaggtctaggtactttaacgttactgtacttactactattaagttcgacgaacgggtccgacgtaaacgttcggtttggggtacggttcgggacggggaacggggaaccgtaacggaccgttacggaacccgttaccggtacgggttaccgacggtaccccgaaacgggtcccgtacccggccccccgttacgggttcctaacccgttccgtttacccgttaccccccg

SEQ ID NO: 343257 - DNA, 521 bp, Homo sapiens
  misc_feature: GZ8MTXP02GU374.22.21.B10.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtntgtctctgtaccacaccaccagcacacgcccccaaactcatgatttangagtcactaagcggcctcgaggggtccctgactcgcttctctcgctccagtctggcgacnccggcctccctgacccgtctcgtgggcctccgaggctgaggatgaggctgtattattactgtactactcatatgcaggcgcaacgttcgttgggtgttcgggcggagggaccaggctacggaccgtccgtaggtcacgcccgaaggcctcgccccctaggtccactctccg

SEQ ID NO: 343258 - DNA, 540 bp, Homo sapiens
  misc_feature: GZ8MTXP02HMVG5.22.21.B10.1.454.CMB.2.raw
  modified_base (243)..(243): a, c, t, g, unknown or other
  misc_feature (243)..(243): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctggtaccaacaccaccaggcacagcccccaaatcatgatttangagtcactaagcggcctcgaggggtccctgactcgcttctctggcctccagtctggcgacnccgggcctccctgacccgtctcgtgggcctccgagctgacggatgaggctagatttatactgtctactcattatgacgaggcggctaactcgttggggtcgttcgggcggagggacccaaggcgttacggaccgttccgtagggtccacggccccgaaggcctcgccccctggtccacttcgtcccg

SEQ ID NO: 343259 - DNA, 526 bp, Homo sapiens
  misc_feature: GZ8MTXP02JKVMJ.22.21.B10.1.454.CMB.2.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccaacaccaccagcacacgcccccaaatcatgatttangagtcactaagcggctcgaggggtccctgatcgcttctctcggctccaagtctggcgacncggccctcctgacccgtctcgtgggcctccgaggctgaggatgagctgtattatactgtctactcatatgcgaggcgacaacgttcgttgggtggttcggcggacgggaccaggcgtcggaccgtcgtacggtcacgacccgaaggcctaccgccccctggtcctactctcccg

SEQ ID NO: 343260 - DNA, 528 bp, Homo sapiens
  misc_feature: GZ8MTXP02FVGYD.22.21.B10.1.454.CMB.2.raw
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccacccaggcacacgcccccaaatcatgatttangagtcactagcggctcgaggggtccctgactcgcttctctcggctccaagtctggcgacnccggcctccctgacccgtctcgtgggcctccgaggcctgaggatgaggctgatttatactgctactcatatgcgaggccgcaacgttcgtttgggtgttcgggcgggtacgggaccaaggctacggaccgttctacggtcacgcccgaaggctcgccccgtggtccactcgtccg

SEQ ID NO: 343261 - DNA, 580 bp, Homo sapiens
  misc_feature: GZ8MTXP02JT1WM.22.21.B10.1.454.CMB.2.raw
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctggtaccaacaccacccaggcacacgcccccaaactcatgatttangagtcactaagcggcctcgaggggtcccngactcgcttctctcgctccaagtctggcacnccggcctcccgtgacccgtctcgtcgggcctccgaggtctagaggatcggaggctgtacttatacgtgtacctactcatatgcgaggccgtacaacgttcgtggggttcgttcgggacgggtacggaaccgtaaggcgtacggtacccgttccgtacgggtccaacggaccccgaagggtcctacccggtcccccgtcggtacccacccgttcgtttaccccg

SEQ ID NO: 343262 - DNA, 606 bp, Homo sapiens
  misc_feature: GZ8MTXP02GZLQX.22.21.B10.1.454.CMB.2.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccaacaccaccaggcacacgcccccaaactcatgatttangagtcactaagcggcctcgacgggtcccngactcgctctctcgctcaagtctggccacnccggccctcctcgacccgtctcgcgggtcctccgaggtctaggacggagttggacggtccttagtaatttaacgttaccgtggtaccttaccgtactaattagtcgtcgaacgggccggtactaacgttcggttggggtcggttccggggacggggtaacggaccgaaaggtcgttccggaccggttaccgtacggaccgacggacccgaaggcccgtccggtcccccgtggtccctacccgtcgtttccccg

SEQ ID NO: 343263 - DNA, 545 bp, Homo sapiens
  misc_feature: GZ8MTXP02HC3K7.22.21.B10.1.454.CMB.2.raw
  modified_base (241)..(241): a, c, t, g, unknown or other
  misc_feature (241)..(241): n is a, c, g, or t
  modified_base (288)..(288): a, c, t, g, unknown or other
  misc_feature (288)..(288): n is a, c, g, or t
tcagacatacgcgtcacgaccggtgctcgatttagtgtcgtcgcaagggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccaacaccaccagcacacgccccaaatcatgatttangagtcactaagcggcctcgacggggtccctgactcgtcttctctcggcctccaagtcgtcggccgaccgccgggcccttcccgtcgtacccgtctcgtcgggcctcccgaggctgaggatgaggtctggtattattactgtactactcattatcgcgaggcggactaacgttcggttgggtgttcgggcggtacggaccagcgtcggaccgtcgtacggcacgccgaaggcctccgccccgtggtccacctctcccg

SEQ ID NO: 343264 - DNA, 505 bp, Homo sapiens
  misc_feature: GZ8MTXP02FNZMI.22.21.B10.1.454.CMB.2.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctgtacaacaccaccagcacagcccccaaactcatgatttangaggtcactaagcggcctcgaggggtccctgatcgcttctctcggctccaagtctggcacncggcctccctgaccgtctcgtgggcctccaggctgaggatgagctgattatactgctatcatatgcaggcacaactcgttgggngttcgggcggaggaccaagctcgaccgtcgtaggtcacgcccaaggctcgcccctcggtcactctccg

SEQ ID NO: 343265 - DNA, 533 bp, Homo sapiens
  misc_feature: GZ8MTXP02HJ07C.22.21.B10.1.454.CMB.2.raw
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctgtaccaacaccaccagcacacgccccaaatcatgatttangagtcactaagcggcctcgacggggtccctgactcgcttctctcgctccagtctggcgacncggcctcctgacccgtctcgtcgggcctccgaggctgaggatggaggctgtattattactgtactactcattatgacgaggcgactaacgtcgttgggtcgttcgggcggaggtacagtcgtcgaccgtcgtacggtcgacgaccgaacggtctccgccccgtcggcctacgtcctccg

SEQ ID NO: 343266 - DNA, 562 bp, Homo sapiens
  misc_feature: GZ8MTXP02GFZNG.22.21.B10.1.454.CMB.2.raw
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccacccaggcacacgcccccaaatcatgatttangagtcactaagcggcctcgaggggtccctgatcgcttctctcggctccaagtctggcgacnccggccctccctgaccgtctcgtcgggcctccgagctgagntgaggctgattatacngtactactcattagtcgacgaggccggactaacgttcgttggggtgttcggggacgggaacgggaccaaggcctacggacccgttcgtacggtaccacggacccgaagggcctccggtcccccgtcggtacctaccgtccgttcccgg

SEQ ID NO: 343267 - DNA, 551 bp, Homo sapiens
  misc_feature: GZ8MTXP02FTSYM.22.21.B10.1.454.CMB.2.raw
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctggtaccaacaccacccaggcacacgcccccaaactcatgatttangagtcactaagcggcctcgaggggtccctgactcgcttctctcggctccaagtctggcgacnccggccctccctgacccgtctcgtcgggctccgagctgagntgagctgattattacgtgtactactctatatgacgaggccgactaacgttgttcgggtgttcgggcgggtaacggaccaggctacggaccgtcgtacggtccacggacccgtaaggcctccggcccccgttcggtactaccgtcgttcccgg

SEQ ID NO: 343268 - DNA, 565 bp, Homo sapiens
  misc_feature: GZ8MTXP02GZAZ0.22.21.B10.1.454.CMB.2.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
  modified_base (434)..(434): a, c, t, g, unknown or other
  misc_feature (434)..(434): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctgtaccaacaccacccaggcacacgacccccaaactcatgtatttangaggtcactaagcggcctcgacggggtcccngactcgcttctctcgctccaagtctggaccgacnccggccctcctcgaccgtctcgtgggcctcgagctgagatgaggctagtatttacgtactgacttacgtntatagtcgacgaggcgactacgttcgttggggtgttcgggacgggaggaccaggccgtacggacccgttacgtaggtaccacggacccgaaggtcctcccgcccccgttggtaccctacctccgtttcccg

SEQ ID NO: 343269 - DNA, 559 bp, Homo sapiens
  misc_feature: GZ8MTXP02IXJTD.22.21.B10.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctgtaccaacaccaccagcacacgaccccaaactcatgatttangagtcactaagcggcctcgagggtccctgactcgtcttctctcgctccaagtctggcgacnccggcctccctcgacccgtctcgtcggggcctccgagctgacggatggaggctagtattattactgtacttactcattatgtacgaggccgactaacgttcggttgggtcgttcgggacgggacgggtacaggtcgtcgaccggtcgtacggtacacgtcccgaaggtcccgtccgcccccgtcggtcctaccgttccgttcccg

SEQ ID NO: 343270 - DNA, 522 bp, Homo sapiens
  misc_feature: GZ8MTXP02JW5PO.22.21.B10.1.454.CMB.2.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccacccaggcacacgcccccaaactcatgatttangaggtcactaagcggcctcgaggggtccctgactcgcttctctcggctccaagtctggcacnccggcctccctgaccgtctcgtgggcctcccgaggctgaggatgaggctgtattattactgctactcatatgcaggcgcaactcgttgggtgttcggcggagggaccagctcgaccgtccgtcggtcacgcccgaaggctcgccccctcggtccacgtctccg

SEQ ID NO: 343271 - DNA, 547 bp, Homo sapiens
  misc_feature: GZ8MTXP02GWV1G.22.21.B10.1.454.CMB.2.raw
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttgtgttacagtatgtctctgtaccacaccaccagcacacgcccccaaatcatgatttangagtcactagcggctcgagggtccctgactcgcttctcncggctcaagtcctggccgacgccggccctccgtagacccgtatcgtcggggccctccgaggtctgaggagtggacggtctgtattattacgtntactactntatgtcgacgacggcgactacgttcggttgggtcggtcgggacggacggacaggtctacgtacgtacgtacgacgacgaccgaacgtccgtccgcccgtcgtacctacgtccgtccg

SEQ ID NO: 343272 - DNA, 579 bp, Homo sapiens
  misc_feature: GZ8MTXP02GJYN6.22.21.B10.1.454.CMB.2.raw
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
  modified_base (564)..(564): a, c, t, g, unknown or other
  misc_feature (564)..(564): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctgtaccaacaccaccagcacacgcccccaaatcatgatttangagtcactaagcggcctcgacggggtccctgactcgcttctctcggctccagtctggccgacnccggccctccctgacccgtctcgtcgggcctccgaggctgaggactggacgctagtatttacttactgtacttacgtcattagtcgacgtacggcggactaacgttcggttcgggtggttccgggcggggaacggtaccgaacggtcgtacggtaccgttaccgtacggtaccacggacccgaaggtccgtccgcccccgtcggtaccnccgttccgttcccgg

SEQ ID NO: 343273 - DNA, 572 bp, Homo sapiens
  misc_feature: GZ8MTXP02F2GLC.22.21.B10.1.454.CMB.2.raw
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (356)..(356): a, c, t, g, unknown or other
  misc_feature (356)..(356): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggngttacagtntgtctctgtaccaacaccaccagcacacgcccccaaatcatgatttangagtcactaagcggcctcgaggggtccctgactcgcttcgtctcggcctccaagtctggacgacnccggccctcccgtgacccgtctcgtgggcctccgaggtctaggagatggaggctagtaatttattacgtgtaccttactcaattagtcgacgagggccgactaacgttcggttggggtcgttcgggacgggtaacgggacctaaggctacggacccgtcgtacggtccacggacccgaaggtcctaccggcccccgtcggtccaccgttcgtcccg

SEQ ID NO: 343274 - DNA, 520 bp, Homo sapiens
  misc_feature: GZ8MTXP02JYB3T.22.21.B10.1.454.CMB.2.raw
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (457)..(457): a, c, t, g, unknown or other
  misc_feature (457)..(457): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccaggcacacgcccccaaatcatgatttangagtcactaagcggctcgagggtccctgatcgctctctcggctcagtctggcncnccggcctccctgacccgtctcgtcgggcctccgaggcctggaggatgaggctgtaattattactgacttactcatatgcagggcgacaacgtcgttgggtgttcggnggacggacagctcgaccgtcacgtcacgccgaaggctccgccccgtcggtcctacgtctcccg

SEQ ID NO: 343275 - DNA, 538 bp, Homo sapiens
  misc_feature: GZ8MTXP02IBWPA.22.21.B10.1.454.CMB.2.raw
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccagcagtgacgttggtgttacagtntgtctctggtaccaacaccacccaggcacagcccccaaatcatgatttangagtcactaagcggcctcaggggtccctgatcgcttctctggctccaagtctggcgacncggccctcctgaccgtctcgtgggctccgaggctgaggntgaggctgatttatactgctacncatatgcaggcgcaacgttcgttgggtgttcgggcggaggggaaccaaggctcggaacccgtccgtaaggtccacggaccccaagggtcccttcggccccccttggtacccacgttcctttcccgg

SEQ ID NO: 343276 - DNA, 631 bp, Homo sapiens
  misc_feature: GZ8MTXP02GYIHV.22.21.B10.1.454.CMB.2.raw
  modified_base (296)..(296): a, c, t, g, unknown or other
  misc_feature (296)..(296): n is a, c, g, or t
  modified_base (368)..(368): a, c, t, g, unknown or other
  misc_feature (368)..(368): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacaccacccagcacacgaccccaaatcatgatttangagtcactaagcggcctcgacggggtccctgactcgtcttcgtcgtcggcctaccgaagtctgggaccgacncccgggtccccttcccgtcgaccccgttcctcgtcggggccctccgaggtcctaggaggactggaggtctaggtaatttacttacgtcgtaccttactacattagcgacgacggccgactaacgttcggttggggttcggttacgggacgggaacgggtaacccgaaaggtccgtaccggtacccgttaccggtacggtcccgaacggaccccgaaaggtcccgtacccgtcccccgtggtaccctaccgttccgttcccccg

SEQ ID NO: 343277 - DNA, 527 bp, Homo sapiens
  misc_feature: GZ8MTXP02JY31F.22.21.B10.1.454.CMB.2.raw
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (410)..(410): a, c, t, g, unknown or other
  misc_feature (410)..(410): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccacaccaccaggcacacgccccaaatcatgatttangagtcactaagcggctcgaggggtccctgatcgcttctctcggctcaagtctggcgacnccggcctccctgaccgtctcgtgggcctccgaggtctggaggatgagctgatttattacngactactcatatgacgaggcgacaacgttcgttgggtcgttcgggcggaggaccagcgtacggaccgtcgtacggtcacgcccgaaggcctcgcccccgtggtccacgtcgttcccg

SEQ ID NO: 343278 - DNA, 649 bp, Homo sapiens
  misc_feature: GZ8MTXP02GQOX3.22.21.B10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgtacagtntgtctctgtaccacaccaccagcacacgaccccaaancatgatttangagtcagtaagcggcctcgacgggtccctgactcgtcttctcgtcggtcctaccgaagttcgtacgggaccaaccgcccgggtccccttcccgtcggtaccccgtcttcgtcggggccctccgaggtcctaggaacggtagtgggacggtcttaggtaactttaagttacctcgtaccttaactactaattatcggacgaggccggtaactaacgttcggttggggttcggttcggggacgggtaacgggaaccgaaggtccgtacggacccgttccgttaacgggtccaaccggaccccgaaacggtcccgtacccggtaccccccgttcggtaccctaccgtttcccgtttcccccg

SEQ ID NO: 343279 - DNA, 631 bp, Homo sapiens
  misc_feature: GZ8MTXP02IZTZ9.22.21.B10.1.454.CMB.2.raw
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtggttacagtatgtctctggtacaacaccaccagcacacgaccccaaactcatgatttangagtcactaagcggctcgagggtcctgatcgtcttctctcggcctccgaagtcgtggccgtacgccgggtccctcccgtcgtaccccgttcgtcgtcggggtccctcccgaggtcctggacgggataggacggtccgttaggttaactttaacgttacgtcgtaccttaccgtacaatttagtcgacgaacgggccggtacctaacgttcggtttcgggggttcgttaccgggacggggaacgggtaccgaagtccggtacggtacccgtacgttacggtccaaccggccgaacggtcccgtcccggcccccgtggtacccgtaccttcgttaccccg

SEQ ID NO: 343280 - DNA, 515 bp, Homo sapiens
  misc_feature: GZ8MTXP02F72G9.22.21.B10.1.454.CMB.2.raw
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (501)..(501): a, c, t, g, unknown or other
  misc_feature (501)..(501): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtatgtctctgtaccaacaccaccaggcacacgacccccaaatccatgatttangagtacactaagcggcctcaggggtccctgatcgcttctctcggtctccaagtctggccgacnccgggcctcccgtgacccgtctcgtgggctccaggctgagatgagctgattatactgctactcatatgcgagccgacaacgttcgtgggtgttcgggcggtaggaccagctcgaccgtcgtagtcacgccaagctcgccccncgtccactcttccg

SEQ ID NO: 343281 - DNA, 552 bp, Homo sapiens
  misc_feature: GZ8MTXP02GFQKD.22.21.B10.1.454.CMB.2.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (425)..(425): a, c, t, g, unknown or other
  misc_feature (425)..(425): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctgtaccaacaccaccagcacacgacccccaaatcatgtatttangagtcactaggcggctcgaggggtccctgactcgcttctcgtcgctcagtctggcacncgcctccgngaccgtntcgtcgggctaccgngngtgagatgagtntagtattatactgtactactactatagnggacgacggcgtacgtacgttcggttgggtcgtacgggacggaacggacgagtcgtacgtaccgtacgtacgtaccgacggaccgaacggtcccgtaccggtccccgtgtcctaccgttccgtcccg

SEQ ID NO: 343282 - DNA, 520 bp, Homo sapiens
  misc_feature: GZ8MTXP02IXD6X.22.21.B10.1.454.CMB.2.raw
  modified_base (221)..(221): a, c, t, g, unknown or other
  misc_feature (221)..(221): n is a, c, g, or t
  modified_base (409)..(409): a, c, t, g, unknown or other
  misc_feature (409)..(409): n is a, c, g, or t
  modified_base (444)..(444): a, c, t, g, unknown or other
  misc_feature (444)..(444): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtatgtctctggtaccaacaccaccaggcacacgcccccaaactcatgatttataggtcactaaggcggctcgaggggtccctgatcgcttctctggcctccagtctggcacacggcctccctgaccgtctcgtgggctccgaggctggagatggagctgattatacngctactcatatgcaggcgcatcgtgggtgttcggnggaggaccaaggctggaccgtctaggtccacgcccgaaggcctacgcccccttggcctacgtccgtcgttcccccg

SEQ ID NO: 343283 - DNA, 585 bp, Homo sapiens
  misc_feature: GZ8MTXP02F5XNJ.22.21.B10.1.454.CMB.2.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccaccagcacacgcccccaaatcatgatttangaggtcactaagcggcctcgacggggtccctgatcgcttctctcggctccgaagtctggccgacnccggccctcccgtgacccgttctcgtcgggctccgaggcctggagntgagctgattatactgctactcaattngcgaggccgactaactcgtttaggggtcgttacgggcgggaacgggaacccaaggtcgtacggtaaacccgtccgttaaggggtccacgtaccccgaaaggtccccgtccggtcccccccgttagggtccctaaccggttcctttacccccgg

SEQ ID NO: 343284 - DNA, 507 bp, Homo sapiens
  misc_feature: GZ8MTXP02FH8BC.22.21.B10.1.454.CMB.2.raw
  modified_base (357)..(357): a, c, t, g, unknown or other
  misc_feature (357)..(357): n is a, c, g, or t
tcagacatacgcgtcacgaccggtgctcgatttagtgtcgtcgcaagggggttctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctcctggtaccaacaccacccaggcacagcccccaaactcatgatttatgaggtcactaagcgggcctcaggggtccctgatcgcttctctggctccaagtctggccgacncggcctccctgacccgtctctgggctcccaggctgaggatgagctgattattactgctactcatatgcagcggcaactctgggtgttcggcggagggaccaagctcgaccgtccaggtcagcccaaggctcgccccctggtcactctccg

SEQ ID NO: 343285 - DNA, 545 bp, Homo sapiens
  misc_feature: GZ8MTXP02HCCBW.22.21.B10.1.454.CMB.2.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccacaccaccagcacacgccccaaactcatgatttangaggtcactaagcggcctcgacggggtccctgactcgcttctctcggctccaagtctggcgacncggcctccngaccgtctcgtcgggctcccgaggcctgacggatgaggctgatttatacgtgacttactcattatgcgaggccgactaacgttcgttggggtgttcggggcggtacgggaccaaggtcgtacggaccgtcgtacggtccacggacccaaggcctccggccccctggtccacgtccgttcccg

SEQ ID NO: 343286 - DNA, 575 bp, Homo sapiens
  misc_feature: GZ8MTXP02I3FOZ.22.21.B10.1.454.CMB.2.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctcctggtaccaacaccacccaggcacagacccccaaactcatgatttangagtcactaagcggcctcgaggggtccctgatcgcttctctcggctccaagtctggcgacncgggcctccctgacccgtctcgtggggcctcccgaggcctgacggatggaggtctgtattattactgtactactcattatgcgtacggcggactaacgttcgtttggggtgttcggggacgggtaacgggaccgtaaggccgtacggaacccgttccgtacgggtccacggcccgaaggcctaccggcccccgtcggtccacgttccgttcccgg

SEQ ID NO: 343287 - DNA, 767 bp, Homo sapiens
  misc_feature: GZ8MTXP02IRF6K.22.21.B10.1.454.CMB.2.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtgttacaagtatgtctctggtaccaacaccaccaggcacacgcccccaaatcatgatttangagtcactaagcggcctgacggggtccctgactccgtcttctcgtcggtcctaccgaacgtccgtgggaccgaaccgacccgggcccttcccccgtacggtacccccgttccgttccgtcggggtcccttaccccgacgggcccgttagggagggaacgttgggaacggtccgtagggttaacttttaactttaaaccggttcgttacccgttaacttaccgtaaactttaagttcgtaccggaacggggtacccgggaaccgtaaaacccggtttcccggtttaagggggtttccggggttttacccggggacgggggtaaaccggggtaacccggtaaaacggcccggttaccgggtaacccccgggttaccccggttaacgggttacccgtaccggaaaccccgaaaacgggtcccgtacccggtcccccccgtaccggggtccctaacccggttcccttttaccccccgg

SEQ ID NO: 343288 - DNA, 551 bp, Homo sapiens
  misc_feature: GZ8MTXP02JGI1X.22.21.B10.1.454.CMB.2.raw
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctggacccagtctgccctgactcagcctccctccgcgtccgggtctcctggacagtcagtcaccatctcctgcactggaaccagcagtgacgttggtggttacaagtntgtctctggtaccaacaccacccaggcacacgcccccaaactcatgatttangaggtcactaaaggcggcctcgaggggtccctgatcgcttctctcggcctccgaagtctggcgacncggcctccctgaccgtctcgtcgggctccgaggtctgaggatggagctgtactttatactgctacttcattatcgcaggcggacaacgttcgttgggtggttcgggcggacgggaccaaggctacggaccgtcgtacggtccgagacccgaaggcctcggcccccgtgggtcctaccttcgttacccg

SEQ ID NO: 343289 - DNA, 626 bp, Homo sapiens
  misc_feature: GZ8MTXP02F5B5N.22.21.B10.1.454.CMB.2.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttacaagtatgtctctggtaccaacaccaccagcacacgacccccaaatcatgatttangagtcactaagcggcctcgacgggtccctgactcgcttctcgtcggctccaagtcctcggcacnccgggtccctccctcgacccgtctcgtcggggcctccgaggcctggaacggtatgggaggtctagtaactttagttactgtaccttactactaattatcgacgagggcccggtactaacgtttcggttcggggttggttaccgggggacggggtaacgggaaacccgaaaggtcgtaacggaacccgttccgtacggggtaccacggaccccgtaaacggcccttacccggccccccgtacgggtcctaaccgtttccgtttccccg

SEQ ID NO: 343290 - DNA, 584 bp, Homo sapiens
  misc_feature: GZ8MTXP02GHU6X.22.21.B10.1.454.CMB.2.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacacccacccaggcacacgcccccaaatcatgatttangagtcactaagcggcctcgacggggtccctgatcgcttctctcggcctcaagtctggccgacnccgggccctccctcgacccgtctcgtgggcctccgaggctgacggatgaggctgatttatactggtncagctagtagggtaacttaccgaaacgtgtaagtggtaacttcgttagggttggggtcggttcggggacggggacgggtaccgagggtcgttacggacccggttccgtagggccacggtacccgaacggtcccgtccggtcccccgtacggttaccc

SEQ ID NO: 343291 - DNA, 627 bp, Homo sapiens
  misc_feature: GZ8MTXP02FMW0J.22.21.B10.1.454.CMB.2.raw
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggngttacaagtatgtctctgtacacaccaccagcacacgaccccaaactcatgatttangagtcactaagcggcctcgacgggtccctgactcgcttctcgtcggcctaccaagtcctggaccgaccgaccgggccccttcccgtacgaccccgttctcgtcgggcctccgaggcctggaagtatggaggctagtaatttacttacgtcgtaccttactactattacgtcgacgacgggccggactaacgttcggttggggttcggttacggggcgggtaacggggtaacccaaggtcctacggtacccgttaccgttacgggtaccaccggacccgaaacggtcccgttacccggccccccgttcgggtacctacccgttccgtttcccccgg

SEQ ID NO: 343292 - DNA, 606 bp, Homo sapiens
  misc_feature: GZ8MTXP02HAB52.22.21.B10.1.454.CMB.2.raw
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaaccagcagtgacgttggtgttacaagtntgtctctgtaccaacaccaccagcacacgacccccaaatcatgatttangaggtacaacgtaagccgccctgaggactctctcatcgtcttcctcagtctactaagtctaggcaaccgacgccctaccctaacatctcgtacggcctccgtagttcgacggacgtagtacttaacttatactgtactacgtttacctttaaagtcggacgtacctactcgttcggttcgggtttacgggacggtacggcctaaccggtagtacggtacccgttccgtacggtcaccggtacccgaacggtccctccgcccccgtcggtaccaccgttccgttacccgttacccccaccccgttccctacccg

SEQ ID NO: 343293 - DNA, 682 bp, Homo sapiens
  misc_feature: GZ8MTXP02I2WFU.22.21.B10.1.454.CMB.2.raw
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttatactntgtctctgtaccaanacaccagcaaacgccccaatcatgatttangagtcactaagcgcctcgacgggtccctgactcgcttctcgtcggccctaccgaagtcgtaggaccaaaccgaccgggtcccttcccgtacggtaccccgttcgttccggtcggggcccttacccggacggggtccgttagggaacgggtagttacggggaaggtccgttaggtaaacttttacgttaaccgtcggacctaggtacccttaccgtaagttaggtaggggacgggtaccacggtacggtaacttaaaggtttttcgggggtacgttaccggggacgggtaacgggtaaccgaaggtccgtacggtacccggttcgtacgggtccacggacccgtaacgggtcctcccggtcccccgtacggtccctaccgttccgtttcccccg

SEQ ID NO: 343294 - DNA, 593 bp, Homo sapiens
  misc_feature: GZ8MTXP02FXJV5.22.21.B10.1.454.CMB.2.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtntgtctctgtaccaacaccaccagcacacgacccccaaatcatgatttangagtcactaagcggcctcgacggggtccctgactcgcttctcgtcgctccaagtcgtggccgacnccggccctccgtcgacccgtctcgtcgggctccgagctgagagtgnggctgtattatacgtgtactactactatagtgacgaggccgtactaacgttcggttggggttcggttccggggacggggaacgggaaccgaaggtccgtaccggtaacccggttaccgtacgggtaccaccggaacccgtaacggtcccgtccgcccccgttacggtcctaccgttccgtttccccg

SEQ ID NO: 343295 - DNA, 532 bp, Homo sapiens
  misc_feature: GZ8MTXP02FMIGC.22.21.B10.1.454.CMB.2.raw
  modified_base (219)..(219): a, c, t, g, unknown or other
  misc_feature (219)..(219): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccngcagtgacgttggtgttacagtatgtctctggtaccaacaccaccaggcacagcccccaaactcatgatttangagtcactaagcggctcgagggtccctgactcgcttctctcgctcagtctggcacncggcctcctgacccgtctcgtcgggctccgaggcctgacggatgaggctgtatttactactgacttacgtcatatcgcgaaggccggactaacgtcgtttaggggtcgttcgggcggacgggacaagcgtacgccgtacgtacgggtcagcccaaggctaccgccccgtcgtcaccgtctcccg

SEQ ID NO: 343296 - DNA, 559 bp, Homo sapiens
  misc_feature: GZ8MTXP02JY8ER.22.21.B10.1.454.CMB.2.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggngttacaagtntgtctctggtaccaacaccaccaggcacacgcccccaaatcatgatttangagtcactaagcggcctcgagggtccctgatcgcttctctcgctccagtctggcgacncggcctccctgaccgtctcgtgggcctcccgaggctgaggatgaggctgattattacngtctactcatatgcgaggccgctaacgtcgttgggtgttcgggacggtacggaccaaggtccgtacggacccgttcgtaacggtcccaacggaccccgaaggtcccgtaccggtcccccgttcggtaccctaccgttccgtttccccg

SEQ ID NO: 343297 - DNA, 669 bp, Homo sapiens
  misc_feature: GZ8MTXP02JPROK.22.21.B10.1.454.CMB.2.raw
  modified_base (111)..(111): a, c, t, g, unknown or other
  misc_feature (111)..(111): n is a, c, g, or t
  modified_base (134)..(134): a, c, t, g, unknown or other
  misc_feature (134)..(134): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
tcagacatacgcgtcacgaccggtgctcgatttagtgtcgtcgcaaggggggggtctcaggaggcagcgctctcaggacgtcaccaccatggcctgggctctgctcctccngagcctcctcactcagggcacgnagggtcctgggcccagtctgccctgactccacgccctcccgtccggcgtccgggtctcctggacagtcacgtcaccatctcctgcactggaaccagcagtgacgttgtagttacagtntgtctcctagaccaacacaccagcacacgccacatntatntatgagtcgacacgcggccgtctcggtcgtctgtctcgtctccncgcgtctacgacgtggccgccgaccgtccctcccgtcgtaccgtccgtccgtcggtccgtccgtaccggtacggtcggtacgggtacgtaggtacgggtacgttacgttaacgtttaacgtttaacgttacgtacgttaacctacgtactaacgtacggtacggtacggtacgggtaccggttacggttacggttcgggggttacggggttacggggtaccggggtaacggggtaccgggtcggaaaccgtaccggtaccggtaccgtaccggtaccggtaccgaacccgtacccggtaccccggtacccggtacccgtaccccgtacccggc

SEQ ID NO: 343298 - DNA, 551 bp, Homo sapiens
  misc_feature: GZ8MTXP02JEOH3.22.21.B10.1.454.CMB.2.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
  modified_base (452)..(452): a, c, t, g, unknown or other
  misc_feature (452)..(452): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccagcagtgacgttggtgttacaagtntgtctctgtaccaacaccacccaggcacacgcccccaaactcatgtatttatgaggtcaacgtaagcgggcctcgacggggtccctgatccgnttctcgtggcctccaagtctggcgacnccgggtcctcccgtgacccgtctcgtcggggcctcccgaggcctggaggattggacgcgtgtatttattactgtacctacttccattangcgaggcggcaactcgttgggtgttcggcggagggacaagcgcgtacgtccgtaggtcacgacccaagtcgactccggcccccttcggtactaccgttc

SEQ ID NO: 343299 - DNA, 542 bp, Homo sapiens
  misc_feature: GZ8MTXP02JHX01.22.21.B10.1.454.CMB.2.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccacaccaccagcacacgcccccaaatcatgatttangagtcactaaggcggcctcgacggggtccctgactcgtcttctctcggctccaagtctggccgacnccggccctccctgacccgtntcgtcgggcctccgagctgacggatgagctgtattntactgctactcattatgacaggcgactacgttcgttgggtcgtcgggcggacggaccgagctacggacccgttacgacggtaccacgacccgaaggccctccggcccccgtggtacctacgttcttcccg

SEQ ID NO: 343300 - DNA, 603 bp, Homo sapiens
  misc_feature: GZ8MTXP02JVEF0.22.21.B10.1.454.CMB.2.raw
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtggttacaagtatgtctctggtaccaacaccaccagcacaccgaccccaaactcatgtatttangtagtacaactaaggccggcctcgacggggtccctgactcgcttctcgtcggctccaagtccgtggaccgacnccgggccctcccgtacggtacccgttctcgtcggggccctccgaggtctggaggagtgaggtctagtatttatactcgtacttactctaatatcgacgaggacgtactaacgttcggttgggttcgtacggggacggacgggtaccgacgcgtacggacccgtacgtacggtaccaccgtaccgaacggtcccgtccggcccccgtcggtacctaccgtccgttccccgg

SEQ ID NO: 343301 - DNA, 664 bp, Homo sapiens
  misc_feature: GZ8MTXP02HTS5V.22.21.B10.1.454.CMB.2.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (385)..(385): a, c, t, g, unknown or other
  misc_feature (385)..(385): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccngcagtgacgttggtgttacagtntgtctctgtaccaacaccaccagcacacgccccaaatcatgatttatgagtcactaagcggcctcgacgggtcctgactcgtcttctctcggcctaccgaagtcgtggacccgacgcccgggcccttcccgtcgacccgttcnccgtcgggccctccgaggtcctaggaaggtcgtggtacggtcttaggtaatttacgttaaccgtcgtactttactacctaagtttaagtcggacgtacgggaccggacttaaccgtttcgggttggggttacggttccggggtacgggaaacgggtaccgaaaggtccgttaccggtaacccgtttaccggtacgggtacccgaaccggacccggtaaacggtcccggtaacccggtcccccccggttacggtccctacccgtttcgtttaccccccgg

SEQ ID NO: 343302 - DNA, 535 bp, Homo sapiens
  misc_feature: GZ8MTXP02H3DJZ.22.21.B10.1.454.CMB.2.raw
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtncttataactatgtctcctggtaccagcaccacccaggcaaacgcccccaactctttaatttggngtcaataaccgcccctnaggggtccngatcgcttcncccgctccagtctggcacncgccctcctgaccatctctggacctcagctgacgatgaggttgacttttacgngtctntctatattagcgacgagactaaataatatagttcggtcgtacgggacggacggaacgtaaaggtcgaccgtacgtacgacaccgccgaacgccgtaccgccctcgtacctacttaccgtccg

SEQ ID NO: 343303 - DNA, 587 bp, Homo sapiens
  misc_feature: GZ8MTXP02JPGE7.22.21.B10.1.454.CMB.2.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacggttggtggttacaagtntgtcctctggtaccaacaccaccaggcacacgacccccaaatcatgatttangagtcactaagcggcctcgaggggtccctgatcgcttctctcggctccgagtctggcgacnccggtccctccgtacgacccgtctcgtcgggccctcccgaggtcctgacggtntcggaggtccttaggtatttatacgtgtaccttacctntaacgtagtcgaccgtaaggccgtactacgttcggttgggtacgttcgggacggacgggaccaggctacggtacccgtacgtacggacgaccgaccgaacggcctcccggtcccctggtcctaccgtcgtttccccg

SEQ ID NO: 343304 - DNA, 556 bp, Homo sapiens
  misc_feature: GZ8MTXP02IDWAJ.22.21.B10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtntgtctctgtaccacaccaccagcacacgcccccaaatcatgatttatgaggtcactaaggcggcctcgacggggtccctgactcgcttctctcggcctccgaagtctggccgacnccgggccccttcctcggacccgttatcgtggggcctcccgaggctgaggtatgaggctgatttatactgcttactcattangcgaggcgactacgtcgtgggttgtcgggnggacgaccgaagcgtcgaccgtccgtacggtccgacgacccgaacggtccgtccgcccccgtcggtacctaccgttccttccccgg

SEQ ID NO: 343305 - DNA, 713 bp, Homo sapiens
  misc_feature: GZ8MTXP02HMTY4.22.21.B10.1.454.CMB.2.raw
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccagcagtgacgttggtggctacaagtatgtctcctggtaccaacaccacccaggcacacgacccccaaatcatgtatttatgaggtcaacgtaagcgggtcctcgtacggggtccctgactccgcttctcctcggctccaagtcgtggcgccgaccggcctcccgtcgacccgtctcgttgggcctccgaggtctaggaggtatggacggtcttaggtaatttacttaacgtgttacccttaaacgttcctaaattcgttacggaccgtaacggggcccgggtaaccttaaaccgtttcgggtttacgggggtttacgggtttcccgggggaaccgggggaaaccgggggttaaccccaaaacggggtccgttaccgggtaaaccccgggtttccgttaaacgggggtccctaaaccgggaacccccgtaaacgggggtcccttaccccgggcccccccgtttacggggtccccttaaccgttttccccccgg

SEQ ID NO: 343306 - DNA, 594 bp, Homo sapiens
  misc_feature: GZ8MTXP02GJ9R1.22.21.B10.1.454.CMB.2.raw
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (473)..(473): a, c, t, g, unknown or other
  misc_feature (473)..(473): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctcctggtaccaacaccacccaggcacacgacccccaaactcatgatttanaggaggtacaactaaaggcgggcctcgaacggggtcccctagactcgctttctcgtcggtctacccaagtcgtaggccgaaccnccgggccctcccgtagacccgttctcgtcggggacctcccgaggcctaggacggagtggacggtctagactttatacgtgtacttaacctntaatatcgacgtacggacgtactacgttcggttgggtcggtcgggacggacggacacgcgtacgaccgtcgtacgccgacgaccgaacgtcctaccgtccccgtcgtcctacgtcgtcccg

SEQ ID NO: 343307 - DNA, 653 bp, Homo sapiens
  misc_feature: GZ8MTXP02HBO4Z.22.21.B10.1.454.CMB.2.raw
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctgacagtcagtcaccatctctgcactggaaccngcagtgtacgttggtgtacagtatgtctctagtaccaacaccaccagcaccaccaccccaatcatatatttangtacgtacacgtaggccggctcggacgggtcctagactcgtctcgtcgccggtctacgagtcgcgccgtacnccggtccctcgtcgtccgtcgtcgtcggacctcgngtcgtgaaggctggacgtntagttattactactctactactagtagtacgcggtacggacggtccgtacgttacgggttcggggttacggggtaccgggtaccggggtaacgggaaccggtaaccgtaccgggttaccgttacccgggaacccggttaccggtaccggaccccgtaaccggtacccgtaacggttccccggtacccccgttccccggttacccccggttaccgttacctacccccggtttccccg

SEQ ID NO: 343308 - DNA, 531 bp, Homo sapiens
  misc_feature: GZ8MTXP02H5N4Q.22.21.B10.1.454.CMB.2.raw
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccaggcaaaccccccatcatcattatggtgtcactcgtcggcccacaggagtctctcatcgccttctcagctcaagtctggcacacggcctccctaacatctctggctccagttgagacgagtctacttattactgactagttcctttaaattggcgtcctactcgtcgtggttttcggcggtagcacgtagtcgaccgtcctcggtcacgtcccaacggcctcgcccccgttcggtcctacctcgtccgttcccgccccttcccg

SEQ ID NO: 343309 - DNA, 721 bp, Homo sapiens
  misc_feature: GZ8MTXP02GXNZL.22.21.B10.1.454.CMB.2.raw
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctgtaccaacaccacccaggcacacgacccccaaactcatgtatttangaggtcactaagcggcctcgacggggtccctgactcgcttctcgtcggtctccgaacgtcgtcggcgaccnccggccctcccgtcgtacccgtctcgtcgggccttccgaggtcctgagggatggaacggtcgtagtaagtttacttacgtcgtacttaacgtctaacgttagttcgggtacgacgggggtacccggacgtaaaccgtttccgggttcgggggtttaccggtttaccgggggaccgggggaaacgggggtaaacccgtaaaacggggtcccgttaaccgggggtaaccccggttacccggttaaccgggggttacccgaaccggttaacccccgggaaaacgggtccccgtccccgggtacccccccggttcggggtaccccctttaacccgtttaccccgttttaccccccgg

SEQ ID NO: 343310 - DNA, 669 bp, Homo sapiens
  misc_feature: GZ8MTXP02G87B6.22.21.B10.1.454.CMB.2.raw
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctccgtggacagtcagtcacatctcctgcactggaaccagcagtgacgttgtgttacagtntgtctctgtaccaacacaccagcacacgaccccaaatcatgatttangaggtacaacgtaaggcggcctcgacggggtccctgactcgcttctctcgctcagtctggcacncgcctccgcgaccgtctcgtgggcctccgaggtctagacgggatcggagtcctaggtaatttaacttacgtcgtactaccttanaaatttagtcgacgaacgggccggtacctaaaccgttgggtttcgggggttcggtttaccgggggacggggtaaaccgggggtaacccaaaagggggtccctttacgggaaccccgggtttacccgttaacgggggtaaccctaacccgggaaccccggttaaaaccggccgtttacccccggacccccggttaccgggtttccccaaacccggtttccctttccccccggg

SEQ ID NO: 343311 - DNA, 559 bp, Homo sapiens
  misc_feature: GZ8MTXP02H27MK.22.21.B10.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggtacaagtntgtctctggtaccaacaccaccaggcacacgacccccaaatcatgatttangagtcacgtaagcggctcgacggggtcctgactcgcttctctcgctacaagtctggacgacnccggcctcccgtgacccgtntcgtgggcctccgaggctagaggatgaggtctagtacttatactntactactnatagcgacgacggccgactacgttcggttcgggtgtacgggacggacggaccgagtcgtacgtaccgtacgtacggaccacgaccgtaacggtcctaccggtccccgtacgtcctaccgtccgtaccg

SEQ ID NO: 343312 - DNA, 556 bp, Homo sapiens
  misc_feature: GZ8MTXP02J0OOP.22.21.B10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccngcagtgacgttggtgttacagtntgtctctggtaccaacaccacccaggcacacgacccccaaatcatgatttangagtcactagcggctcgaggggtcctgatcgcttctctcggcctaccgagttccgtggaccgacnccgggccctccctgacccgtctcgtcgggcctccgaggctgagntgaggctgtaattatactgactactcatagtgcgtaggcgactaacgtcgttggggtcgttcggggcggtaacgggtaccgaagtccgtacgacccgtcgtacggcacggtcccgaagcctaccggcccctacggtcctaccgtcttcccg

SEQ ID NO: 343313 - DNA, 651 bp, Homo sapiens
  misc_feature: GZ8MTXP02HEEUM.22.21.B10.1.454.CMB.2.raw
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacnccaccagcacacgccccaaatcatgtatttangaggtcactaaggcggcctcgacggggtcctgactcgtcttctcgtcggcctacagtcgtggaccgacgccgggcccttccgtcggacccgttcgtcgtcgggggtccctaccgacggtccgtagggacgggtacgttagggacggttccgttaaggttaactttaacgttacctacgtacctttaacgttactaattagtcggacggacgggtaccggactaacggtttcggttgggggttacggttccggggacgggacgggtaaccgaggtccgtacggacccgtacgttacggacgacggacccgtaacggtcctcccggtacccccgtggtaccctccgttacgtttccccg

SEQ ID NO: 343314 - DNA, 634 bp, Homo sapiens
  misc_feature: GZ8MTXP02GX4BH.22.21.B10.1.454.CMB.2.raw
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccagcacacgcccccaaatcatgtatttangagtcaactaggcggcctcgacgggtcccngactcgtcttctcgtcggtcctaccagtcgtcggccgacgccgggtccctcccgtcgtacccgttctcgtcgggccctcccgaggtcctgaggntggagtctgtaatttactacgtcgtacttactactaatttacgtcggaccgaacgggtccggtaactaaccggtttcgggtttacgggggttcggttaccggggacggggtaacgggaaccgtaacggtcgtaccggtaacccgttcggtacggtaccaccggtaccgaacggtcctcccggtcccccgttcggtaccctccgttcgtttcccccg

SEQ ID NO: 343315 - DNA, 585 bp, Homo sapiens
  misc_feature: GZ8MTXP02JJ2O8.22.21.B10.1.454.CMB.2.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctggtaccaacaccaccaggcacacgacccccaaatcatgatttangacgtcacgtaagcggcctcgacgggtccctgatcgcttctcgtcgctccaagtctggccacgccggccctccgtcgacccgtctcgtcgggtcctccgaggtcctaggaggagtgagtcgtagtattatactgtactacttcatagtcgacgacggacgaccgtaacgttcggttagggtggttacgggcggacggacctaacggcgtacgtacccgtcgtacggtaccgaccgaccgaacggtccctaccggtccccctaccggtacctacccgttccgttaccccg

SEQ ID NO: 343316 - DNA, 529 bp, Homo sapiens
  misc_feature: GZ8MTXP02GJDJJ.22.21.B10.1.454.CMB.2.raw
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (417)..(417): a, c, t, g, unknown or other
  misc_feature (417)..(417): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttacagtatgtctctggtaccaacaccaccaggcacacgccccaaactcatgatttangagtcactaagcggcctcgaggggtccctgatcgcttctcncggctccagtctggcacncggcctccngaccgtntctgggctccgnggctgagatgagctagtattattactgcttacctnactatcgcgaggcggctaacttcgttgggtgttcgggaggtagggaccaaggctacggaccgtctacggtccacgccgaaggctccggccccctggtaccactcgttacccg

SEQ ID NO: 343317 - DNA, 550 bp, Homo sapiens
  misc_feature: GZ8MTXP02G53DL.22.21.B10.1.454.CMB.2.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaaccagcagtgacgttggtgttacaagtntgtctctggtaccaacaccacccaggcacacgcccccaaactcatgatttangaggtcactaagcggcctcgacggggtccctgatcgcttctctcggctccagtctggcgacnccggcctccngacctctcgngggcctccgagctgaggatgagtctagtattatactgtactactcatatgacgaggcgactaacgttcgttggggtgttcgggacggtagggacctaaggccgtacggaccgtccgttacggaccgacgcccgaaggtcctccgtcccccgtggtcctacctcttccccg

SEQ ID NO: 343318 - DNA, 613 bp, Homo sapiens
  misc_feature: GZ8MTXP02GB8AV.22.21.B10.1.454.CMB.2.raw
  modified_base (244)..(244): a, c, t, g, unknown or other
  misc_feature (244)..(244): n is a, c, g, or t
  modified_base (289)..(289): a, c, t, g, unknown or other
  misc_feature (289)..(289): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtacacaccaccagcacacgccccaaatcatgatttangaggtcacgtaagcggtcctcgacggggtccctggactcgtcttctcgtcggcctaccgaagtcgtggaccgtacgccgggcccctacccgtcggacccgttctcgtcggggcctccgaggcgtggaggatggaggcttaggtaatttattacgtgtacttactctattagtgacgtacggccgtacgtaacgttcggttcggggtcggttacgggacgggtacgggtaccgaacggtcgtacggtacccgtcggttaacggtccgaaccgtacccgaacggtccctaccggtcccccgtacggtccaccgttccgttccccgg

SEQ ID NO: 343319 - DNA, 607 bp, Homo sapiens
  misc_feature: GZ8MTXP02IZ3XI.22.21.B10.1.454.CMB.2.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccaggcacacgacccccaaactcatgatttangagtcactaagcgggctcgaggggtccctgactcgcttctctggctccaagtctggccgacncggccctcccgtgacccgtctcgtcggggcctccgaggtcctgacggatgaggcctagtattatactgtactactcattatcgcgaggccggacaaccgtttcgttaggggttcggtttcggggacgggtaacggggtaaccaaaggtccgtacggtaacccggtccgttaagggtccgaaccggtaccccgaaacgggtcccgtaccggtccccccgtacgggtccctaaccggttcctttccccgg

SEQ ID NO: 343320 - DNA, 624 bp, Homo sapiens
  misc_feature: GZ8MTXP02HHFO0.22.21.B10.1.454.CMB.2.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtagtacaagtatgtctctggtaccaacaccaccaggcacacgcccccaaactcatgtatttangagtcactaagcggcctcgacggggtcctgactcgcttctcncgctccaagtctggcgacncggccctccgtgaccgtctcgtcgggctccgaggctggacggtatgggaggtctaggtaactttagttacgtggtaccttacttaccatttacgcgtaccggaacgggcgaccgtaacgtttcggtttgggggtcggtttaccgggggcgggtaaccgggaaccgaaacggccggtacgtacccggttccgtaacgggtaccgaccggacccgtaacgggcccgttaccgcccccggttcggtaccctaccgttcgtttcccccgg

SEQ ID NO: 343321 - DNA, 588 bp, Homo sapiens
  misc_feature: GZ8MTXP02HW1U1.22.21.B10.1.454.CMB.2.raw
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtggttacaagtatgtctctgtaccacacaccagcacacgccccaaatcatgtatttangagtcaactaagcggcctcgaggggtccctgactcgtcttctctcggctccagtctggccgacnccgggtccctccctgacccgtctcgtcggcctccgaggctgaggatggacggctgtattattactcgtacttactactattagtgcgaggcgactaacgttcgttagggtggtcgggacgggaacgggtacaaacggtccgtacggtaccggttccgtaacgggtaccgaacgacccggaacggtcccgtacccggcccccgttcggtaccctaccgtttccgtttccccgg

SEQ ID NO: 343322 - DNA, 695 bp, Homo sapiens
  misc_feature: GZ8MTXP02HH3UJ.22.21.B10.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtagttacaagttntcgtctcgtacgtaccacaccaccgagcacaccaccccaactcatagtattagngtacgtacacgtacggccggtccgtacggacgggtcctagtactccgtcttcgtcgtccgtcctaccgtacgtcgtacggaccgaccgtcccggtcccttcccgtccgtacccgttccgtccggtccgggtccctacccggacggtccgtagggtaacgggtacgtcgggtacggtccgtacggttaactttacgtacgtcgttcgttcgtacttacgttacgttcggacggtacggtcccgtaccgttacggttacgggtttcggggttcggtaccggggacgggtaacggtacgtacggtccgtacggtaccggtacggtacggaccgaaccggtacccgtaacggtcccgtacccggtccccgtccggtaccttaccggttcccgtcccg

SEQ ID NO: 343323 - DNA, 696 bp, Homo sapiens
  misc_feature: GZ8MTXP02IYE6W.22.21.B10.1.454.CMB.2.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaagggggggtctcaggaggcagcgctctcaggacgtcaccaccatggcctgggctctgcctcctcctcagcctcctcactcagggcacagggtcctgggcccagtctgccctgactcagcctcctcgcgtccgggtctcctggacagtcagtcaccatctcctgcactggaaccagcagtgacgttgngttacaagtntgtctctgtaccaacaccaccagcacagcccccaaatcatcgatttangagtcacgtaacgcggtcctcgacggggtccctgactcgtcttctcgtcggctaccgaagtctggaccgactccgggtcctcccgtagtacccgtctcgtgggcctccgaggtcctaggaaggtctacgacggtcttaggtaactttacgttacctgtacctttaaacgtctaaagttacgtcgaccggtacggaccggtacgttaaaccggttcggttacgggggttacggtttcccgggggaacggggtaaccgggttaaacccgtaaagggtcccgttacgggtaaacccccggtttacggttaaaccgggtaccaacccgggtaccccggtaaacggttccccgttaacccggtcccccccgttaaggggtccccttaaccggtttcccggtttacccccgg

SEQ ID NO: 343324 - DNA, 534 bp, Homo sapiens
  misc_feature: GZ8MTXP02GF61L.22.21.B10.1.454.CMB.2.raw
  modified_base (356)..(356): a, c, t, g, unknown or other
  misc_feature (356)..(356): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtatgtctctggtaccaacaacacccaggcacacgcccccaaactcatgatttatgaggtcaactaagcggctcgacggggtccctgactcgcttctctgcctcagtctgcgacncgcctcctgaccgtctcgtcgggctccgagcctggagatggagctagtagtttatactgtactactcatactgcgaggcgactactcgttgggtgttacggcggtaggacagcgtacgaccggtcacggtcacggacccgaaggcctaccgccccgtacggtctaccgtcgtttcccg

SEQ ID NO: 343325 - DNA, 614 bp, Homo sapiens
  misc_feature: GZ8MTXP02HX7XY.22.21.B10.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggccagtctgccctgactcagcctccctcgcgtccgggtctcctggacagtcagtcacatctcctgcactggaaccngcagtgacgttgtgtacagtntntctcngacacacacngcacacaccaancatntattatgagtacacgtacgcggctcggtacgggtcctgactcgtcttctcgtcgcctacacgtcgtcggacgacgccgtcctcccgtacgtacccgtctcgtacggtccctaccgacggtcgtaggaggtagtagacggtctagttaacttacgttactcgtacttactacgtaattacgtacgacgtacggtacgtactacggttcggttgggtcggttacgggacgggtaacggtaccgtacggtccgtaccggtacccggtacggtaccggacgtaaccggacccgtaacgggtccctaccccggtccccgttaccggtaccctaccgttcccgtccccg

SEQ ID NO: 343326 - DNA, 620 bp, Homo sapiens
  misc_feature: GZ8MTXP02JPQG9.22.21.B10.1.454.CMB.2.raw
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggtacagtatgtctctgtaccaacaccaccaggcacacgccccaaatcatgattangagtcactagcggctcgacgggtcctgactcgcttctctcgcctcgaagtcgtggacaacgccgtcctccgtacgtaccgtcgtcgtcgggtcctaccgnggtctaggacggagttcggacggtcgtagtaatttagttacgtacgtactactactattagtcgacgacggcggtaacctacggttcgttgggggtcgttccggggacgggtaacgggaccgaaggtccgtacggtaccccgttacgttacggggacctaacggaccccggtaagggcccgttcccggtacccccggttcggtacctttaccgttacccgtttaccccg

SEQ ID NO: 343327 - DNA, 565 bp, Homo sapiens
  misc_feature: GZ8MTXP02JORP4.22.21.B10.1.454.CMB.2.raw
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttaacagtatgtctctgtaccacaccaccagcacacgcccccaaatcatgatttangagtcataagcggctcgacggggtccngatcgcttctctcgctccagtcctggccgacnccggtactccctggacccgtctcgtgggacctccgaggtcctggaggattggagcctagtattataccgtgtaccttactcaattatgcgaggccggtanaaaccgttcggttgggtcgttcgggngggacgggactaacggctacggtaaccgtccgttaacggccgaacgccgaacggtccttaccgcccccgtcggtcctacctcgttacccg

SEQ ID NO: 343328 - DNA, 590 bp, Homo sapiens
  misc_feature: GZ8MTXP02FVL7E.22.21.B10.1.454.CMB.2.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtatgtctctggtaccaacaccacccaggcacacgacccccaaatcatgatttangagtcagtaagcggcctcgacggggtccctggtactccgcttctctcggcctccaagtctggccacnccggcctccctgaccgtctcgtcgggctcgaggctggacgatgagctagtatttattactgtactactcgtaatatcgacgaggccgtctaacgttcggtttggggtcggttaccgggacggggtacggaaccgtaacggccgttacgggacccgttaccgtacggtccgacggtacccgaaggtcccgtccggacccccgtcggtaccaccgttccgttccccg

SEQ ID NO: 343329 - DNA, 572 bp, Homo sapiens
  misc_feature: GZ8MTXP02G8NFE.22.21.B10.1.454.CMB.2.raw
  modified_base (297)..(297): a, c, t, g, unknown or other
  misc_feature (297)..(297): n is a, c, g, or t
  modified_base (407)..(407): a, c, t, g, unknown or other
  misc_feature (407)..(407): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgtcctgactcagcctcctccgcgtccgggtctcctggacagtcagtcaccatctcctgcactggaaccagcagtgacgttggtgttacagtatgtctctggtaccaacaccaccaggccacacgacccccaaactcatgtatttangagtcaactaaggcggcctcgacggggtccctgactcgtcttctctccggtctccaagtctggccgacgccggccctccgtcgaccgtctcgcgggctcgagctgacggntgagtctgtatttagtactcgtactactctatagtcgacgtaggccgcgtaacgttcgttgggtcgttcggggacggacggacgacgtcgtacgtaaccgtcgtacgtaccacggacccaagggtcctccggtcccccgttggtaccctccgttccgttcccccg

SEQ ID NO: 343330 - DNA, 566 bp, Homo sapiens
  misc_feature: GZ8MTXP02FU526.22.21.B10.1.454.CMB.2.raw
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccngcagtgacgttggtgttacaagtatgtctctggtaccaacaccacccagcacacgcccccaaactcatgatttangagtcactaagcggcctcgacggggtccctgatcgcttctctcggcctccaagtctggccgacnccggccctcctcgacccgtctcgtgggctccgaggctggagntgagctgattatactgtactacnctatagtgacgtaggccgactaacgttcggttagggtcgttcgggacgggacggaacctaaggcttacggaacccgttcgtacggtacacgtacccgaacggtcctccgcccccgtcggtccaccgttccgtttcccgg

SEQ ID NO: 343331 - DNA, 576 bp, Homo sapiens
  misc_feature: GZ8MTXP02HCT6Z.22.21.B10.1.454.CMB.2.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtaggttacagtatgtctctgtaccaacaccaccagcacacgaccccaaatcatgtatttanagagtacacgtaaggcggtacctcggacggggtcctgactcgtcttcgtctcggctaccagtcgtggccgaccgccggcccttccgacgtacccgtccgtcgtcgggcctccgaggtcgtggaggatggaggtctgtaatttattactgtactactctatagtgcgacggcgacgtacgtcggttgggtcgtacgggacgggacggtacacggcgtcggtaccgtcgtacgtcgacgaccgaacggtccaccggtccccgtcgtaccgtccgtcgttcccg

SEQ ID NO: 343332 - DNA, 557 bp, Homo sapiens
  misc_feature: GZ8MTXP02JMAMZ.22.21.B10.1.454.CMB.2.raw
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgtacagtatgtctctgtaccaacaccaccagcacacgaccccaaactcatgatttangagtcatagcggctcgacgggtcctgactcgtcttctcgtcgctacgagtcgtggcacnccggcctccgtcgtacccgtcgtcgtcgggcctaccgaggtctggaggtntggagtctagtattagtactgacttactactatagtgacgacggacgactaacgttcggttagggtcgttcggggacggaacggacgtagctacggaccgtacgttacggaccgtacgccgaagccgtccgccccgtggtcctacgttccgtaccg

SEQ ID NO: 343333 - DNA, 553 bp, Homo sapiens
  misc_feature: GZ8MTXP02JT4SX.22.21.B10.1.454.CMB.2.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (455)..(455): a, c, t, g, unknown or other
  misc_feature (455)..(455): n is a, c, g, or t
  modified_base (543)..(543): a, c, t, g, unknown or other
  misc_feature (543)..(543): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtccaccatctcctgcactggaaccagcagtgacgttggtgttaacagtntgtctctggtaccaacaccacccaggcacacgacccccaaatcatgatttangagtcactaagcggcctcgacggggtccctgatcgcttctctcggcctacgagtctggccgacnccggccctcccgtcgtacccgtctccgtcggggaccctccgaggtctcggaggagtggaggctaggtacttattactgtactactctattagngcgaggcgtacaacgttgtcggtgttcgggcgaggtaccagcgtcgaccgtcgtacgcgacgacccgaagccgtcgccccgtcgtccncgtcttcccg

SEQ ID NO: 343334 - DNA, 716 bp, Homo sapiens
  misc_feature: GZ8MTXP02H3T99.22.21.B10.1.454.CMB.2.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctccgtggacagtcagtcaccatctcctgcactggaaccngcagtgacgttgtgtanagtngtctcngaccacaccaccagcacacacccaatcatgtattatgagtacaacgtaagccggcctggacggggttccctgactcgtcttcgtcgtcggctaccgtaagtcgttcggaccgaacnccggtcccttcccgacggtaccccgttctccggtttcgggcccttacccgaacgggtacgtacgggaacgggtacgtacgggacggttacttaagttaaacgtttaacgttaccgtacgttaaccttacgttacgtaagttaacgacggacgggtacggtaccggtaaccgttaacggtttcgggttcgggggttaccggttacgggggaacggggtaaaccggtaacgtaacggtccgttaccggtaaacccggttaccggtaacggtacccgaacccggtacccggtaaccggtccccgttacccggttcccccgttacggttacccttacccgtttccccggttccccg

SEQ ID NO: 343335 - DNA, 533 bp, Homo sapiens
  misc_feature: GZ8MTXP02JZK2U.22.21.B10.1.454.CMB.2.raw
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (431)..(431): a, c, t, g, unknown or other
  misc_feature (431)..(431): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacagtatgtctctggtaccaacaccaccagcacacgcccccaaatcatgatttangaggtcactaagcggccctcaggggtccctgactcgcttctctcggctcaagtctggcaacncggcctcccgtgaccgtntcgtgggcctcccagggcctggaggatgaggctggattatactgcagctcattaggnggagcagcgtaagtagttggtacggtcggcggtaacggacagtcgtacgtaccgtcgtacgcgacgaaccgacggtccgtccgtcccgtcgtacctacgtcg

SEQ ID NO: 343336 - DNA, 542 bp, Homo sapiens
  misc_feature: GZ8MTXP02FWD4H.22.21.B10.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgccactggaaccagcagtgacgttggtgttacaagtntgtctctgtaccaacaccaccaggcacacgacccccaaactcaatgatttangagtcactaagcggcctgacggggtcccngatcgcttctctcgctcagtctggcacncggcctccgtgacccgtctcgtcgggcctccgaggtcnggacgatgacggctagtatttactactgtactactanatagngtacgagcgacaacttcggttgggtgtcggnggacggacagcgtacgaccgtctacgtcacgtaccgaacggtcctaccggcccctcggactacgtccgttcccg

SEQ ID NO: 343337 - DNA, 570 bp, Homo sapiens
  misc_feature: GZ8MTXP02JZ4F0.22.21.B10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtntgtctctgtaccacaccaccagcacacgaccccaactcatgtatttatagtcactaagcggctcgacgggtccctgactcgcttctctggccctcagtctggcgacgaccggccctcccgtcgacccgtctcgtcgggcctcccgaggcgtggacggatggaggctgtaatttagttactgtctactctatagtgacagggcgacaacgttcgttggggtcggttcgggacgggacgggacctaaggcgtcggaccgtccgtacggtcgacgcccgaacggtcctaccggcccccgtcggtccctacgtccgttccggttcccccg

SEQ ID NO: 343338 - DNA, 583 bp, Homo sapiens
  misc_feature: GZ8MTXP02GSSM4.22.21.B10.1.454.CMB.2.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccagcagtgacgttggtgttacagtntgtctctgtaccacaccaccagcacacgccccaaactcatgatttangagtcataagcggcctcgagggtcctgatcgctctcgtcgctcgaagtcgtggcgtacnccgggtccctcccgtgacccgttcgtcgtcgggccctaccgacggtcctgaggacgtggaggtctagtattacttacgtcgtactactctaatagtcgacgacggccgtactaacgtcgttggggtcggttcgggacgggtaacggaccgaagtcgtacggaccgttacgtacggaccaccgcccgaaggtcccgtaccgtcccccgtcggtaccctaccgttccttccccg

SEQ ID NO: 343339 - DNA, 646 bp, Homo sapiens
  misc_feature: GZ8MTXP02FZFNI.22.21.B10.1.454.CMB.2.raw
  modified_base (222)..(222): a, c, t, g, unknown or other
  misc_feature (222)..(222): n is a, c, g, or t
  modified_base (306)..(306): a, c, t, g, unknown or other
  misc_feature (306)..(306): n is a, c, g, or t
  modified_base (430)..(430): a, c, t, g, unknown or other
  misc_feature (430)..(430): n is a, c, g, or t
  modified_base (472)..(472): a, c, t, g, unknown or other
  misc_feature (472)..(472): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcaggtgacggttggtagttaacagtatcgtctcctaggtaccaacacccaccaggcaccaccgaccccaaatcatgtatttangacgtcaacgtacggccggtcctacggacggggtccctggtactccgtcttcgtcgtccggccttcgaacgttcgtcgaccgacgccggtccctcccgtgtacccgtcttcgtacgggctacgnggctggaggtatcggagcttagactttatacgtctactactntatacgtgaccgtaggccgtactacgtttcgggttgggtacggttacggggacgggaaccgggtaactacgggtcgttaccggaccgttacggtaccgggtaccgaccggaaaccggaacgggttccctacccggggtccccccttgggtaccctaccttaccggtttcccccg

SEQ ID NO: 343340 - DNA, 615 bp, Homo sapiens
  misc_feature: GZ8MTXP02F3IZ6.22.21.B10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (428)..(428): a, c, t, g, unknown or other
  misc_feature (428)..(428): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcagggcacagggtcctgggcccagtctgccctgactcagcctcctccgcgtccgggtctccgtggacagtcagtccaccatcctcctgcactggaaccngcagtgacgttggtgtacagtntgtctctgtaccacaccaccaggcacacgacccccaaactcatgtactttatagacgtcaacgtaaggccggcctacgacggggtccctgtactcgcttcgtctcggtctacctaagtccgtcggaccacgaccggtccctcccgtcgacccgttcgtcgtcggggcctccgaggctgaacggtntgacggtctagtattatactgtactactcattagtgacgaggccggtactaacgttcggttcggggtcgttacggggacggggaacgggaccctaaaggtcccgtagggtacccctacgtacgggtaccacgggtaccccgaaggtccctccggtccccccgtcgtaccgtccttccgtttcccccg

SEQ ID NO: 343341 - DNA, 616 bp, Homo sapiens
  misc_feature: GZ8MTXP02HT5BX.22.21.B10.1.454.CMB.2.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgacacaccaccagcacagccccaaatcatgatttangagtcactaagcggctgagggtcctgatcgtcttctctgctcagtctgccacnccggcctacctcgacccgttncgtcgggcctccgaggccgtgaacggctaggagggctaggtactttaacgttacgtactacgttacctactaactttancggtacgacggtcggacctaacgtttcggttcggggtacgttcggggacgggaacgggtaccgaaacggtccgtacgggtaacccgttcccggtaaggtcccgaaccggacccgaaacgggtcccgttacccgggtacccccccgtgggtaacccctaccgttcccgtttcccccgg

SEQ ID NO: 343342 - DNA, 674 bp, Homo sapiens
  misc_feature: GZ8MTXP02JQT9Q.22.21.B10.1.454.CMB.2.raw
  modified_base (291)..(291): a, c, t, g, unknown or other
  misc_feature (291)..(291): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctccgtggacagtcagtcaccatctcctgcactggaaccagcagtgacgttggtgttacagtatgtctctgtaccacaccaccagcacacgccccaatcatagtatttangtacgtacacgtaacgcggtcctacggacgggtccctgactcgtccttctcgtcggctaccgtagtcgtcggccgacgtccggccctcccgtcgacccgttcgtcggtcgggcctacccgacggtcgtacggaggtagtaggacgtcgtaggtaactttacttacgtcgttacctacttactaagttgtacggacggacgggtaccgtaccgttaaccggtttcgggtttcggggttaccgggtttaccgggggacggggtaaacggtaacccgaacggtccgtaaccgggtaccccgttacggtaccggtacccgaccgaacccggtaacggtcccgtaccccgtcccccggttccgtaccctaccggttccctttcccccg

SEQ ID NO: 343343 - DNA, 739 bp, Homo sapiens
  misc_feature: GZ8MTXP02GRLOI.22.21.B10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccngcagtgacgttggtgtacagtntgtctctgtaccacaccaccagcacacgaccccaaactcatagtatttacaggacggtacaacgttaaacggccgggtcctcggaaccgggggttcccctggtacgtccggtcttccgttcgtccgggtcctaccgtaacgttccgtaggggacccgaacgtacccggggtccctcccccgtcggaccccgttccgttccgtcgggggcccttcccgagggtcccttagggagggaacgttcgggacggggtcttagggttaaactttattaccgttacggtacccttacgttaccgatttaacgtcggtacgaacggggtcccggaacttaacccgttgggtttacgggggttccggtttcgggggacggggtaacgggtaaccgaaacggtccggtaccggtaacggttacccggttacggacccgaaccgtacccggtaacgtcccgtaacccggtcccccgtaccggtccctaccgtttccgtttacccccg

SEQ ID NO: 343344 - DNA, 610 bp, Homo sapiens
  misc_feature: GZ8MTXP02FU4V4.22.21.B10.1.454.CMB.2.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacaggatcctgggctcagtctgccctgactcagcctcgctcagtgtccgggtctccgtggacagtcagtcaccatctcctacactggaaccngcagtgatgttggtgttataactatgtctcctgtaccaacagcacccaggacaaacgcccccagactcatcatttangctgtacaaagtaacgccgccctgacggggtccctgactcgcttctcgtcggcctcgaagtctaggaccaaccgaccggtccctcccgtacgaccctatcctcgtcgggaccctccgaggtcttaggaagtagtggaacggtcttaggtaatttacgtttactcggtctcgtcttacttagtttcgcgtaacggtccgtaccgttaacgtacggtttcggggttcggttaccggggacgggtacgggtaaccgaacgtccgtaacggtacccgttaccgtacggtaccgaaccggtacccgacggtccccg

SEQ ID NO: 343345 - DNA, 573 bp, Homo sapiens
  misc_feature: GZ8MTXP02HST25.22.21.B10.1.454.CMB.2.raw
  modified_base (297)..(297): a, c, t, g, unknown or other
  misc_feature (297)..(297): n is a, c, g, or t
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccagcagtgacgttggtggttaacagtatgtctctggtaccacaccaccagcacacgcccccaaactcatgtatttangtaggtcaacgtaaggcggcctcgaggggttaccctgtactcgtcttctcgtcggtctccaagtctagccgacnccggcctccgcgtacccgtctcgtcgcctcgagcgtgagntgagctgtaattatactgctatcatatgacgagcgacacgttggtcggtggtcgggacggacggacgaagtccgtcgacccggttacgtacggtaccaccggacccgaaaggtcccgtacccggtcccccgtacggttacccaccgtttccgtttcccccgg

SEQ ID NO: 343346 - DNA, 590 bp, Homo sapiens
  misc_feature: GZ8MTXP02G4Z4K.22.21.B10.1.454.CMB.2.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctccgtggacagtcagtcaccatctcctgcactggaaccagcagtgacgttggtgtacagtntgtctctgtaccacaccaccagcacacgccccaaatcatgatttangagtacacgtaagccggcctcgacgggtccctgtactcgtctctcgtccgctaccgagtcgtggccgaacgccggtccctcccgtcgtacccgtctccgtcgggcctccgaggtctggacggtatcggagtctagttaatttacgttaactgtaccttacgtactattacgtgacgtaggcgtactacgttggtgggtcggtcgggacggtacgggaactaggtccgtacggtaccgtaccgttacgggcctaacggcccgaaggtcccgtaccgcccgttacgcctaccgtcttccccg

SEQ ID NO: 343347 - DNA, 672 bp, Homo sapiens
  misc_feature: GZ8MTXP02FKXI2.22.21.B10.1.454.CMB.2.raw
  modified_base (220)..(220): a, c, t, g, unknown or other
  misc_feature (220)..(220): n is a, c, g, or t
  modified_base (299)..(299): a, c, t, g, unknown or other
  misc_feature (299)..(299): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtggttacaagttatgtctcctggtaccaacaccacccaggcacacgacccccaaatcatgatttangagtcactaaggcggcctgacggggtccctgactcgcttctcgtcggtcctaccgaagtctcggccgacgccggccctcccgtcgacccgttctcgtcggggtccttcccgaggtcctaggacgggtagtagggacggtcttaggtaactttaacgttaccgtcgtaccttaaccttctaattaagttcggacccggaaggggtacccggaccttaaaccgttccgggtttagggggttccgggttaccggggacgggtacggggtaacccgaaggtcccgttacggtaaacccgttccgtaaacggtccgacggtaccccgaaaggtcccgttcccgtacccccggtcggttacccacgttcccgttccccg

SEQ ID NO: 343348 - DNA, 627 bp, Homo sapiens
  misc_feature: GZ8MTXP02GJ8H0.22.21.B10.1.454.CMB.2.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (423)..(423): a, c, t, g, unknown or other
  misc_feature (423)..(423): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacagtagtgtctcctgtaccaacacccaccaggcacacgacccccaaactcatgatttangaggtcaatagcggcctcgacgggtccctgactcgcttctctcggcctaccgagtctggccgtacnccggtccctcccgtcgtacccgtccgtcgtcggggtcctcccgaggcctaggaggtanggacggtcctaggttaatttacgtttactcgtaccttaacctactattaagtcgacgacggtaccgaccgtaacgttccggttggggtcgttacggggacgggtaacggtacgaacgtcgtacggacccgtacgttacggtaccgacggtaccccgaaaggtccgtaccgcccccggttcgtaccgtaccgtccgtttccccgg

SEQ ID NO: 343349 - DNA, 651 bp, Homo sapiens
  misc_feature: GZ8MTXP02F2BFY.22.21.B10.1.454.CMB.2.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgtacgttggtgttacagtntgtctctgtaccacacaccagcacacgaccccaatcatgtatttangagtcaacgtaacggcggctcggacgggtccctgactcgcttctcgtcggtacctaccgaaggttctcggaccgacgccggtccctcccgtacggtaccccgttcgttcggtcgggtccttacccgaggggtccgttagggacgggtacgtggtaacggtcttaggtaatttacgttacttcgtacttacctagtatagttcggaccgtagggaccgtacgtaacgtttcgggttacggggttcgttacggggacgggaacggaccgtaacgtccggtacgtacccggttcgtacggtacgaccgtacccgaacggtccgtccccggtaccccgtcgttaccgtcccgtccgtttcccccg

SEQ ID NO: 343350 - DNA, 605 bp, Homo sapiens
  misc_feature: GZ8MTXP02I1RT3.22.21.B10.1.454.CMB.2.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtaccacaccaccagcacacgcccccaaactcatgatttangagtcactaagcggcctcgacggggtccctgatcgcttctctcgctccagtctggccgacnccggtccctcccgtgaccccgttctcgtcggggccctccgaggtcctaggacgggattggaggtcctaggtaactttagttactgtaccttacttcaattagtcgacgaggccggactaacgttcgttgggtcggttcgggcggtaacgggaacctaaggtcctacggtaacccggttcgtaacgggtccgaaccggcccgtaaacggcccttaccggccccccgttgggtccctacgttccgtttccccgg

SEQ ID NO: 343351 - DNA, 596 bp, Homo sapiens
  misc_feature: GZ8MTXP02JKEVK.22.21.B10.1.454.CMB.2.raw
  modified_base (132)..(132): a, c, t, g, unknown or other
  misc_feature (132)..(132): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
  modified_base (360)..(360): a, c, t, g, unknown or other
  misc_feature (360)..(360): n is a, c, g, or t
  modified_base (464)..(464): a, c, t, g, unknown or other
  misc_feature (464)..(464): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcaggcacncgggtcctgggcccagtctgccctgactcagccctccctccgcgtccggtctcctggacagtcagtcaccatctcctgcactggaaccagcagtgacgttggtagttacaagtntgtctctggtaccacaccaccaggcacacgacccccaaatcatgatttangagtacactaagcggcctcgacgggtccngactcgtcttctcgtcgcctcgagtctcggcgacnccggtccctacccgtgacccgttctcgtgggccctacccgaggtccgtaggaggtacgtggacggtcttagtaactttattacctgtacctactactattacgngacgacggcgtacgtacgttcggttgggtcggtacgggacgggaacggaccacggtctaccggtaccgtacgtacggcgacccgaccgaacgtcccgtacccggtccccgtcgtaccctcgttcccgtcccg

SEQ ID NO: 343352 - DNA, 583 bp, Homo sapiens
  misc_feature: GZ8MTXP02J2LWY.22.21.B10.1.454.CMB.2.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccntctccngcactggaaccngcagtgacgttgtgttacagtntgtctctggtaccacaccaccagcacacgaccccaatcatgatttangagtcatagcggctcgagggtcctgatcgtcttctctcgctcgagtctgcgacnccggcctacccgtgaccgtcgtcgtcgggcctccgaggctggaggtacngagggtctgtatttaacgtttacctcgtacttactctagtatggacgacggccgtacgtaacgttcggttcgggttcggtcgggacggggacggaaccgacggtccgtacggtacccgttacgtacggtaccgaccggacccggtaaggtcccgtacccggtccccgttacgtccgtaccgttccgtcccg

SEQ ID NO: 343353 - DNA, 543 bp, Homo sapiens
  misc_feature: GZ8MTXP02FTM7H.22.21.B10.1.454.CMB.2.raw
  modified_base (357)..(357): a, c, t, g, unknown or other
  misc_feature (357)..(357): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctgtaccaacaccacccaggcacacgcccccaaactcatgatttatgaggtcactaagcgggcctcaggggtccctgatcgcttctctcggctccaagtctggcgacncggcctccctgaccgtctctgggctccaggctgaggatgagctgattatactgctactcatatgcaggcgcaactcgttgggtgttcgggacgggacgggaccgaaggcgtcgacccgttcgtacggtcacggaccccgaaggtcccgtacggccccccgtcggtacctaccgttccgtttacccg

SEQ ID NO: 343354 - DNA, 575 bp, Homo sapiens
  misc_feature: GZ8MTXP02JFJPT.22.21.B10.1.454.CMB.2.raw
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctggtaccaacaccaccaggcacacgcccccaaactcatgatttangagtcactagcggctcgacggggtccctgactcgcttctcgtcggtctaccgtacgtcgtcggaccgacnccgggtccctcccgtcgacccgtctcgtcgggcctcgacggctggacggtatggagctagtatttatacgtgtctgcttacgtatttcgaccgagcctacctacgtcggtttgggtcggttcgggacgggtacggtacacggcgttacggccgttacgtcggaccacgccgaaggtccctaccggccccgttcggtctaccgtctcccgg

SEQ ID NO: 343355 - DNA, 616 bp, Homo sapiens
  misc_feature: GZ8MTXP02FI3FH.22.21.B10.1.454.CMB.2.raw
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccagcagtgacgttggtgttacaagtatgtctctggtaccaacaccaccaggcacacgacccccaaactcatgatttangagtcagtaagcggcctcgacggggtccctagatccgcttctcgtcggcctaccagtctggccgacncggccctcccgtgacccgtctcgtcgggctccgaggtcgtcgaggactggacgctagtaatttagttactgtacttactctatagtcgtacgaggccggactaacgttcgtttcggggttacggttccggggacggggtaacgggaaccgtaacggccgttacggtaacccgttcggtaccggtaccgaccgtaacccggtaacgggcccttacccggcccccgttcggtacctaacccgttccgttcccccg

SEQ ID NO: 343356 - DNA, 677 bp, Homo sapiens
  misc_feature: GZ8MTXP02F5E21.22.21.B10.1.454.CMB.2.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (491)..(491): a, c, t, g, unknown or other
  misc_feature (491)..(491): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtagttataactntgtctcctgtaccaacacaccagcaacgaccccaatcatnatttangagtcactaagccgcctcgacggggtcccngtactcgtcttctcgtcggcccctaccgaagtcgtggaccaaaccgaccgggtcccctcccgtcggtacccgttccgtccgtcggggacctcccgaagggtcctaggagggtatgggaaggtcttaggttaatttaactttaccgtagtccttaacctctaaattacgnggacgaacggggccgtaaccgtaaccgtttcgggtttgggggttacgttcgggggtaccggggaacgggtaacctaaggtcctaacggttaccccggttacgtaacgggtacccacggaccccggaacggtcccgtcccgtcccccgtccgggttacctaaccgttcccgtttaccgtaccccccg

SEQ ID NO: 343357 - DNA, 657 bp, Homo sapiens
  misc_feature: GZ8MTXP02IUPCL.22.21.B10.1.454.CMB.2.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctccgtggacagtcagtcaccntctcctgcactggaaccagcagtgacgttggtgttacagtntgtctctgtacacaccaccaggcacacgacccccaaactcaatcgtatttatgaaggtcaacgtaacggcggcctcggtacggggtccctgtactcgtcttctcgtcggtctccaagtcgtggaccgacgccggccctcctcgacccgtctacgtcgggcctccgacggtcgtagaacggngtaggtacgtccgtaggtaactttacgttaaccgtcggtaccttaaccgtacttaagtaacgttcgacggtacgggccgtacgtaaccgttcgggttcggggtcgggtacgggtacggggaacgggtacccgtaaggtccgtacggttacccggtaccggttacggtaccgtaaccgaccgaaacggtcctacccggtcccccgtcggtccctaaccgttccctttccccgg

SEQ ID NO: 343358 - DNA, 581 bp, Homo sapiens
  misc_feature: GZ8MTXP02HDMSL.22.21.B10.1.454.CMB.2.raw
  modified_base (291)..(291): a, c, t, g, unknown or other
  misc_feature (291)..(291): n is a, c, g, or t
  modified_base (357)..(357): a, c, t, g, unknown or other
  misc_feature (357)..(357): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaaccagcagtgacgttgtgtacagtatgtctctgtaccaacaacaccaggcacacgacccccaaatcatgatttangtagtcactaaggcggctcgacgggtcctgactcgtcttactctcgcctaccagtcgtggccgacnccggccctccgtcgaccgtctcgtcgggcctcgaggcctgaggactggacgtctaggtaatttatacgngtactacctanagttangacgaggaccgacgtaaccgttggtttacgggtcgggttacgggcgggaacgggacgtaaacgcgtacggtacccgtacgtacggaccgacgacccgtaacggccttccgcccgtacggtcctcggtcctttccccgg

SEQ ID NO: 343359 - DNA, 695 bp, Homo sapiens
  misc_feature: GZ8MTXP02IA8QZ.22.21.B10.1.454.CMB.2.raw
  modified_base (228)..(228): a, c, t, g, unknown or other
  misc_feature (228)..(228): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtccaccatcctcctgcacgtcggaaaccngcgtaggtgtacggttgggtacgtaataagttntcgtcctcgtacgtaaccacacccaccgagaccacaccaccccaactcatgtattangtagtacacgtacggcggtcctacggacgggtcctgacgtccgtcttcgtcgtccgtacctaccgtagtcgtcggaccgacccgtccggtcccttaccgtccggtacccgttccgttccggtcggtccctacccggtaggtccgtaggaaggtacgtgggtacggtacgttaagtaactttacgttacgtacgtaccttacgtactacgttacgtacgacggaacgggtaccgtaaccgttacggttcgggttcgggggttcggtacggggacggggaacggtaaccgacggtccggtacggtacccggtacgtacggtaccgaccggaccgtaacggtcccgtaccgtccccgtccgtacctaccgttccgtcccg

SEQ ID NO: 343360 - DNA, 662 bp, Homo sapiens
  misc_feature: GZ8MTXP02F2I1M.22.21.B10.1.454.CMB.2.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (456)..(456): a, c, t, g, unknown or other
  misc_feature (456)..(456): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctctgcactggaaccagcagtgacgttggtgttacagtatgtctctgtaccaacaccaccagcacacgaccccaancatgatttangagtacaataaggcggtcctcggacgggtccctgactcgtcttcgtcgtcggtcctaccgaagtcgtcggacgtaccgccggccctcccgtacgtaccccgtcgtcgtcgggccttaccgcggtaccgtaggaggtagtggacgtcgttagtaactttacgtacgtntacctactatattagcgtacgacggccgtaacgtacgtttcgggttcgggttcgggttacgggacggggtaacgggaaccgtaaacggtccggtaccggtaacccggttaccggtaacgggttcccggaacccggtaaacgggtccctaccccgggtcccccgtacgggtaccctacccggtttcccgttacccggtttccccccg

SEQ ID NO: 343361 - DNA, 545 bp, Homo sapiens
  misc_feature: GZ8MTXP02HALE8.22.21.B10.1.454.CMB.2.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctcctgcactggaaccagcagtgacgttggtgtacaagtntgtctctgtaccaacnccaccagcacacgccccaaatcatgatttangaggtcactaagcggcctcgaggggtccctgactcgcttctctggctntaagtctggcacncggcctccctgaccgtctcgtgggcctccgaggcctgaggactgaggctgtattattactgactactcattagtggagcagaccgaataaggtttggtacggttcggggcgggaacgggacccaaaggtctacggaccgtaccgttacggccaacggaccgaaggcctacgccccctaggtccacttcgttcccg

SEQ ID NO: 343362 - DNA, 553 bp, Homo sapiens
  misc_feature: GZ8MTXP02FZT4I.22.21.B10.1.454.CMB.2.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctctggtaccaacacccaccaggcacacgcccccaaactcatgatttangagtcactaagcgggcctcgacggggtccctggatcgcttctctcggctccaagtctggcacnccggccctcccgtgacccgtctcgtcgggcctccgaggcctgaggntgaggctagtatttattactgtacttactcatntagcgaggcgcaacgttcgttggggtcgttcgggcgggaacggacgaaggctcggaccgtcgtacgggactacgacccgaaggtcctcgccccctcggtccaccgttctcccgg

SEQ ID NO: 343363 - DNA, 570 bp, Homo sapiens
  misc_feature: GZ8MTXP02FMM38.22.21.B10.1.454.CMB.2.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccngcagtgacgttggngttacaagtntgtctctggtacaacaccaccagcacacgcccccaaancatgatttangagtcataagcggcctcgacggggtccctgactcgcttctctcgctccaagtctggccgacgaccggccctccctggacccgtctcgtcgggcctccgaggtccgtggaggactgaggctggtaatttacttacgtcgtaccttactactattagttgacgacggccgtactaacgtcgtttcggggttggttccgggacgggaacggacaggtctacggaccgtcgtacgtacgacgccgaacggctaccgcccctcggtacctctcgttcccg

SEQ ID NO: 343364 - DNA, 629 bp, Homo sapiens
  misc_feature: GZ8MTXP02FMKED.22.21.B10.1.454.CMB.2.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttgtgttacagtatgtctctgtaccaacaccaccagcacacgacccccaaatcatgtatttangaggtcaactaacgcggcctcgacggggtccctgatcgcttcgtctccggctaccgaagtcgtcggccgaacnccggccctccctagacccgtctcgtcgggcctccgaggtcctaggacgagtggagctagtatttatactgaccttactctaaagtgtcgacggagccggtaactaaccgtttggtttcggggttcggttccgggggacggggtaaacggaacccgaaggtccggtaaccggtacccggtccgttaacgggtccgaccggtaccccgaaacggtcccgttacccggtccccccgttcggtaccctaccgtttcctttcccccgg

SEQ ID NO: 343365 - DNA, 576 bp, Homo sapiens
  misc_feature: GZ8MTXP02JYXOK.22.21.B10.1.454.CMB.2.raw
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagacatacgcgtcacgaccggtgctcgatttagtgtcgtcgcaaggggggtctcaggaggcagcgctctcaggacgtcaccaccatggcctgggctctgctcctcctcagcctcctcactcaggacacagggtcctgggcccagtctgccctgactcagcctccctccgcgtccgggtctcctggacagtcagtcaccatctcctgcactggaaccagcagtgacgttggtgttacagtatgtctctggtaccaacaccacccaggcacacgcccccaaatcatgatttangaggtcactaagcggctcgaggggtccctgatcgcttctctcggctcaagtctggccacnccggcctcccgtgacccgtctcgtgggcctccgaggctgacggatgaggctgattatactgctactcatatgacgaggcgcaacgttcgttgggtcgtttcgggcggtaagggacccaaaggccgtacggaacccgttccgtaacgggtccgaaccggacccccgaaaggggtccccgtaccggcccccccgttcgggtccctaccgttcccgtttaccccgg

SEQ ID NO: 343366 - DNA, 574 bp, Homo sapiens
  misc_feature: GZ8MTXP02IEXEF.22.21.B10.1.454.CMB.2.raw
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (438)..(438): a, c, t, g, unknown or other
  misc_feature (438)..(438): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgtacagtntgtctctgtaccacaccaccagcacacgaccccaaactcatgatttangagtcactaagcggtactcgtcggggtccctgatccgtcttctctcggcctacctagtctggccgacgccggtccctaccgtcgacccgttccgtcgtcgggtccctcgaggctggacgtagtcgaggtctagtaattacgttacgngtacttactctattacgtgcgacggcgactacgttcgttgggtgttcgggacggtaacggacgaagtcgtcgtacccgtcgtacgtcgaacgacccgaaggccctccggcccccgtaggtccaccgttcgtccccg

SEQ ID NO: 343367 - DNA, 675 bp, Homo sapiens
  misc_feature: GZ8MTXP02JUNYF.22.21.B10.1.454.CMB.2.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctgtaccacaccaccagcacacgaccccaaatcatgtatttangacgtcactaagcggcctgacggggtccctgactcgtcttctctcggctaccaagtctggccgactccggccctcccgtcgtacccgtctcgtcgggtcctaccgaggtcctgggacggacgtgggacggtactagttaatttactttacgtcgttaccttaccgttactaattactgggaccgtacgggcccgtaaccttaacggtttcggtttcggggttacgggtttccggggacggggaacgggtaacccgaaacggtccgttaccgggtaccccgttaccgggttacggtacccgtaaccggaccccggtaaacggtcccgttacccccgggtaccccccgttcgggttaaccctcccgtttcccgtttccccccgg

SEQ ID NO: 343368 - DNA, 594 bp, Homo sapiens
  misc_feature: GZ8MTXP02GVHMW.22.21.B10.1.454.CMB.2.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacagtntgtctctgtacaacaccaccagcacacgccccaaactcatagatttangagtcactaagcggctcgaggggtccctgactcgctctctcgctaccagtctggccgacnccggtccctcccgtcgtacccgtctcgtcgggcctcgaggctggacggatggagctagtactttattacgtgtacttactactattatgacgaggccgtactaacgttcggttggggtcgttcgggacgggtaacggggaccaacggtcgtacggtaccccgttacgtacggtaccgacggacccgtaacgggtcccgtcccggtccccccgttcgggtaccctaccgttccgtttaccccg

SEQ ID NO: 343369 - DNA, 566 bp, Homo sapiens
  misc_feature: GZ8MTXP02JS8KJ.22.21.B10.1.454.CMB.2.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccntcncctgcactggaaccngcagtgacgttggtgttaacagtntgtctctgtaccaacaccaccagcacacgacccccaaatcatcgatttatgacgtcactaagcggcctcgaggggttccctgactcgcttctctcgctccaagtctggacgacnccggccctccgtcgaccgtctcgtcggcctcgaggctgacggntgaggctggtactttacttacgtcgtacttacctacgtacttagtcgacgtaggccgactaacgtcgttgggtgttcgggacggacggacacgcgtcggaccgtcgtacgtaccacgtccgaaacggccgttccgaccccgtccggtaccgtaccgtcgtttccccg

SEQ ID NO: 343370 - DNA, 636 bp, Homo sapiens
  misc_feature: GZ8MTXP02IDZEQ.22.21.B10.1.454.CMB.2.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (407)..(407): a, c, t, g, unknown or other
  misc_feature (407)..(407): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtcccgggtctctggacagtcagtcaccatctctgcactggaaccagcagtgacgttggtgtacagtntgtctcgtgtaccacacaccngcacgacaccccaaatcatagtatttatagacggtcaacgtaaggccggtacctcgacggggtccctggactcgtcttctcgtcggcctccgagtcgtcggaccgcgccggtcccctccgtcggtacctccgtcggtgggtcccnccgtaggctaggaggacgtggacgtctagttaattaacttctgccttactactagttagcggacgacggggaccgtaacttacgtttcgggttcggggttttggtccgggggaaacgggtacggggtaaaccaaacgggttccggtacggtaaccgtcggttacggaaccgccgaaccgaacggggtccctaccggtcccccgtcggtcctaccgtttccgttcccccg

SEQ ID NO: 343371 - DNA, 638 bp, Homo sapiens
  misc_feature: GZ8MTXP02GX5Y7.22.21.B10.1.454.CMB.2.raw
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctggtaccaacaccacccaggcacacgcccccaaatcatgatttangagtcaactaagcggcctcgaggggtccctgactcgtccttctcgtacggctcctaagtcgtggaccgaacgccgggtcccctcccgtacgtacccgttctccgtcggggcctccgaggtcgtggaaggtacgtgggaggtcgttaggtaactttaagttacgtcgtacttaaccttactaattatcggacgacgggcggacctaaacgttcggttacggggttcggttcgggacggggtaacggaaccgaaggcctacgggaaacccgtcgttacgggtacaaccggacccgtaacgggtcctacccggtccccctcggtacctaccgtcgtttacccccg

SEQ ID NO: 343372 - DNA, 577 bp, Homo sapiens
  misc_feature: GZ8MTXP02IK7OX.22.21.B10.1.454.CMB.2.raw
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (435)..(435): a, c, t, g, unknown or other
  misc_feature (435)..(435): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttaacagtatgtctctgtaccaacaccacccagcacaccgccccaaactcatgatttangagtcactaagcggcctcgaggggtccctgcncgtcttctctcgcnccagtctggcacgcggccctcctgaccgtctcgngggcctcgagtctggacgatggagtcttagtaattacgttactgtaacttctactattangtacgaggccggtataacgttcggtagggttcggtcggacgggtacggaacgacgtcgtacggtaacccgtcgttaaacgtcgaaccgtaccgaacggcccttacccggccccgtcccggttctaaccgttcgtttaccccg

SEQ ID NO: 343373 - DNA, 680 bp, Homo sapiens
  misc_feature: GZ8MTXP02JFAAG.22.21.B10.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatcctcctgcactggaaccngcagtgacgttggtgttacagtntgtctctgtacacaccaccagcacacgccccaaatcatcgatttangagtcactaaggcggcctcgacgggtccctgactcgtcttctcgtcgcctccgagtcgtggccgacnccggcctcccgtcgacccgtctcgtcgggcctcccgaggtcctaggaggtacgtggacgtccgttaggtaacttttaacgttaccgttacggttacccttaccgttactaagtttaacgtcggtaccggaccgggacccggtacctaaaccgttcgggtttacgggggtcggttaccggggacggggaacgggtaacccgtaacggtccggttaccggtaacccggttaccggttacggttaacccgacccgaccccgtaaaccggtcccgttaccccggtacccccgttcggtaaccctacccgtttcccgtttcccccgg

SEQ ID NO: 343374 - DNA, 618 bp, Homo sapiens
  misc_feature: GZ8MTXP02F32QF.22.21.B10.1.454.CMB.2.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
  modified_base (369)..(369): a, c, t, g, unknown or other
  misc_feature (369)..(369): n is a, c, g, or t
tcagacatacgcgtcacgaccggtgctcgatttagtgtcgtcgcaacgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccngcagtgacgttggtggttacaagtntgtctctgtaccaacaccaccagcacacacccccaaatcatgatttangagtcactaagcggctcgacggggtccctggactcgtcttctcgccggtcctaccgagtccgtaggccgaacnccggccctcccgtcgacccgttctcgtcgggctccgaggcctgaggatgagctagtattattactagtactaactctatagtgacgaggaccggacttaacgtccggtttaggggtcggtttacgggacggggtaacgggaaccgtaaacgccgtaccggtaaaccgtcccgtaaggtccgaacgaccccggtaaacggccctacccggtcccccgtacggtttaccccgtaccgtttaccgttccccg

SEQ ID NO: 343375 - DNA, 630 bp, Homo sapiens
  misc_feature: GZ8MTXP02HCLU2.22.21.B10.1.454.CMB.2.raw
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatctctgcactgaaccagcagtgtacgttggtagtacagtatgtctcgtagtaccaacacccaccagcacacgaccccaaancatgtattatgagtcaacgaagcggtctcggtacgggtcctagacgtccgtcttacgtcgtccggacctaccgtaagtccgtacggacgtaccgaccggtcccctccggtacgtacccgttcgtcgtcggggcctaccgngtcgaggacggtacgaggtacgtgtagttacgtttacttacgtcgtaacttacctagtatacgtacggcggaacggtcgaactacggttcgggttgggttacgtacggggacgggaacggtaccgaaggttcacggtacccgtacgtcggtaccgaccgaccgaacgtccgtcccgtccccgttcggtacctcccgtcttaccccg

SEQ ID NO: 343376 - DNA, 702 bp, Homo sapiens
  misc_feature: GZ8MTXP02IA3K3.22.21.B10.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatctcctgcactggaaccagcagtgacgttggtggtacaagtatgtctctgtaccaacaccaccagccacacgcccctaaacncatgatttangagtcaacgtagcggcctcgacggggtccccagactccgtcttcctcgtcggacctaccgaagtcctcgggaccaaaccgcccgggtccccttaccccgtacggaacccctacttcccttcggtaccgggcccttacccggacggtccgtacggaaacggacgttaggaacgggtctacggtaagtttaacgttacttacggtcttacggtcctttcttacgttttacggcggtaaccggccgtaccgttaacgttaccgggtttggggttcggtttaccggggtacggggtaacgggtaccgaaacggtccgtacggtaaaccccggttccgtaacgggttccaccggtaacccgaacggggtcccttacccggcccccggttccggtacctacccgtttccccg

SEQ ID NO: 343377 - DNA, 614 bp, Homo sapiens
  misc_feature: GZ8MTXP02HSWRE.22.21.B10.1.454.CMB.2.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggaccagtcagtcaccatcctcctgcactggaaccagcagtgacgttggtgttacagtntgtctcgtgtaccaacaccaccagcacacgaccccaaatcatgtatttatgagtcaacgtaacggccgggcctcgtacggggttcccngtactccgtcttctcgtcggcctaccgaagtcgtggaccaacgcccgggtcctccccgtggtaccccgttctcggtcgggccctccgaggccgtaggacggagtggacggtcgttagtacttaacgttactcgtacttactctatagtgcgacggcgacgtaacgttggttcgggtcggttcggggacgggacggtaccgaacggtcgtacggtacccgttcgtacggtacaccgacctaagtcgccgtcccgccccgttccggtcctaccgtttcccc

SEQ ID NO: 343378 - DNA, 618 bp, Homo sapiens
  misc_feature: GZ8MTXP02FRJAT.22.21.B10.1.454.CMB.2.raw
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggnggttacaagtatgtctctggtaccaacaacacccaggcacacgacccccaaatcatgatttangagtcatagcggctcgagggtccngactcgcttctcgtcgcctaccgaagtcgtacggaccgacnccgggccctcccgtgaccctctcgtcgggcctccgaggctagaggtatggacggtctagtaatttatacctgtacttactcgtaatgtcgaccgagggcccggactaaacgttccggtttggggtggttaccggggacggggaacggaacctaaggctacgggtaacccgttccgtaaggtcccgaacggaccccgaaaacggggtccctacccgggtcccccccgttggtaccctaccgttcctttacccccgg

SEQ ID NO: 343379 - DNA, 652 bp, Homo sapiens
  misc_feature: GZ8MTXP02F306H.22.21.B10.1.454.CMB.2.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactggaaccngcagtgacgttggtggttacagtntgtctctgtaccaacaccaccagcacaccgaccccaaancatgtatttangtagtcagtaacggcggcctcggacgggtcctgtactcgtcttcgtcgtcggcctccgaagtcgtcggaccgaccgccggtcccctcccgtggtacccccgttcgtcgtcgggtccctccgaggtccgtaggacggtagtggacggtcgttagttactttagttacgtcgtaccttactactacgttaatcggacggtacgggcccgtacgttaacgttccggggttagggttccggtcggggacggggtaacggaaccgtacggtcgtaccggtaaccgttcggtacgtaccgaccgtacccggaacggtcccgtacccgtcccccggtacggtcctaccgttccgtttcccccg

SEQ ID NO: 343380 - DNA, 586 bp, Homo sapiens
  misc_feature: GZ8MTXP02GYYDU.22.21.B10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (367)..(367): a, c, t, g, unknown or other
  misc_feature (367)..(367): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgtacagtntgtctctgtaccaacaccaccagcacacgacccccaaatcatgtaatttangacgtacaacgtaaggcggcctcgacggggtccctgactcgtcttctcgtcgctaccgaagtcgtggccgacnccgggtccctccgtcgaccgtctcgtcgggcctccgaggtctaggaggtagtgagtctagtatttacttacgtctaactacctataattagcgacgtaacggccggtactaacgttcggttggggtcgttacgggacggaacggtaccagtcgtacgacccgttacgtacgtccgacgaccgaacggcctaccggcccctcggtccaccgttctccccg

SEQ ID NO: 343381 - DNA, 558 bp, Homo sapiens
  misc_feature: GZ8MTXP02FO1D1.22.21.B10.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (396)..(396): a, c, t, g, unknown or other
  misc_feature (396)..(396): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccngcagtgacgttggngttacaagtntgtctctgtaccacaccaccagcacacgccccaaatcatgatttangagtcactaagcggcctcgacgggtcctgatcgcttctctcgctcaagtcgtggcacgcggcctccctgacccgttctcgtcgggcctccgaggccgtgaacggtntggagtcctgtaatttattacgtgtactactactatacgtgacgtaggccgactaacgtcgtttagggtcgttcggggacggaggggaccaaggcctggaccccgtgtacggcacgtaccgaacggtctcccggccccttacgggccacctccgtttccccg

SEQ ID NO: 343382 - DNA, 567 bp, Homo sapiens
  misc_feature: GZ8MTXP02GUB88.22.21.B10.1.454.CMB.2.raw
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtaccaacaccaccaggcacacgcccccaaactcatgatttangaggtcactaagcggcctcgacggggtcctgatcgtcttctctcggctccaagtctggccgacnccggtcctaccctgacccgttctcgtcgggcctccgaggcctgacggatgagctgactttatactgtcttactcatntgcgaggcgactacgttggttgggtggttcggacgggcggaacgaacggtctacggtacccgttcgtaacggtccacgaccccgaaggtccctccggtccccccgtagtcccaaccgttccgtttccccgg

SEQ ID NO: 343383 - DNA, 684 bp, Homo sapiens
  misc_feature: GZ8MTXP02F7IA1.22.21.B10.1.454.CMB.2.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (471)..(471): a, c, t, g, unknown or other
  misc_feature (471)..(471): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtccaccatctcctgcactggaaccngcagtgacgttggtagtacagtntgtctctagaccacaccaccagcacaccgaccccaaatcatatattagngagtacaactaggccggcctcgacgggtccngtactcgtcttctcgtccgtcctacctaagtcgtggaccgtacgcccggtaccctcccgtcggtacccgttccgtacggtcgggtacctcccgaaggccgtaggacgggattacggggacgtcgttaagtaactttactacgtntaccttacgtacttacttagacggtacggacgggtccgtaacgtaccggtttcgggtttggggttccggtaccgggggaacgggtacgggaaaccgtacggtccgtaaaccgggttacccgttacgggtaacggaccggtacccggaccggtaaccggtcccggttaacccggtcccccgttacggtaccctccgtttccgtttaacccccgg

SEQ ID NO: 343384 - DNA, 684 bp, Homo sapiens
  misc_feature: GZ8MTXP02J3I84.22.21.B10.1.454.CMB.2.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatcctcctgcactggaaccagcagtgacgttggtgtacagtntgtctctgtaccacnccaccagcacacgccccaatcatgatttangagtcacgtaagcggcctcgacgggtccctgactcgtcttctcgtcggctacgacgtcgtggccgacgccggcctcccgtcgaccgttctcgtacgggtccctccgaggtcctagggaaggtacgttggacgggtccttaggtaactttaaacgtttaccgtcggtacctttaacgttcgaaatttacgtcggaccggaaggggtcccgtaaccgtttaaaccggtttcccgggtttaggggggttcccggtttaccgggggacggggaacgggtaaccgaaacggttccgacgggtaaccccgtttcggaacgggtacccgaccggtaccccggaacgggttcccgccccgggttcccccgtaccgggttacctacccggttcctttccccccgg

SEQ ID NO: 343385 - DNA, 642 bp, Homo sapiens
  misc_feature: GZ8MTXP02JBKM7.22.21.B10.1.454.CMB.2.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacngtcagtccaccatctctgcactgaaccngcagtgacgttggngttacaagtntgtctcgtgaccacaccaccagccacacgaccccaaatcatntaatttangacgtacaacgtaacggcggtcctaggacggggttccctaggtactccgtccgttaccttcgtccggccttaccgtacgttcgtacgggccgaaccgcccggggtcccttacccggtacggtaccccgtgttccgtcggggtacctccgtacgtcgtacgaggtagtagacggtctagtacgttatactcgtacctacctagtaactgtacgcgtaacgtccgactacgttcgggttacgggtcgttacggggacggacgggtacacggtacgtaccggaccgttacgacggtacaaccggtaccgaacgtccgtacccgtcccggcgtacacccgttcgttccccg

SEQ ID NO: 343386 - DNA, 588 bp, Homo sapiens
  misc_feature: GZ8MTXP02FWNAF.22.21.B10.1.454.CMB.2.raw
  modified_base (294)..(294): a, c, t, g, unknown or other
  misc_feature (294)..(294): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgtacgttggtggttacaagtatgtctctgaccaacaccaccagcacacaccccaaatcatgatttangagtacactaagcgccctgacgggtcctgactcgcttctctcgtcctcgaatctggaccaacgccgccctccgtcgacccgtctcgtcggcctccgaggtctaggagacgtggacgtcttagtaattacgttacgtgactacgtctacgtagtacggtagggagacgagaccgttaagttagttgggtacggtcgggaacggggacgacgtaacgccggtacgtaccgttaccgacgtaccgaccgaacccggaacggtcccgtcccgtccccgtcggtaccctacgttccccg

SEQ ID NO: 343387 - DNA, 615 bp, Homo sapiens
  misc_feature: GZ8MTXP02GJROF.22.21.B10.1.454.CMB.2.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
tcagacatacgcgtcacgaccggtgctcgatttagtgtcgtcgcaaggggggggtctcaggaggcagcgctctcaggacgtcaccaccatggtctgggctctgctcctcctcagcctcctcactcagggcacagggtcctgggccagtctgccctgactcagcctccctccgcgtccgggtctcctggacagtcagtcaccatctcctgcacgtcggaaccagcagtgacgttgtgttacagtntgtctctgtaccaacaccaccaggcacacgaccccaaancatagtatttangacggtcaacgtaacggcggtacncggacggggtcctgactcgcttctcgtcgctaccgaacgtcgtcggaccgacgccggtccctcccgtacgaccgttctcgtcgggcctcgagtctgacgagtgacggtntagtacttagtactcgtacttactactagtagtgacggacggcgtactacggttcggttaggggttcggtaccggggacgggtaacggaaccgtacggtccgtaccgtaccgtaccggtacggtaccgacggacccgaaccggtcctacccggtccccgttacgtaccgtaccgtttcccgtacccg

SEQ ID NO: 343388 - DNA, 603 bp, Homo sapiens
  misc_feature: GZ8MTXP02HODRS.22.21.B10.1.454.CMB.2.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
  modified_base (577)..(577): a, c, t, g, unknown or other
  misc_feature (577)..(577): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccngcagtgacgttggtggttaacaagtntgtctctgtaaccaacaccaccgagcacacgccccaaatcatgattangagtcaactaaggcggcctacgacgggtccctgatcgtacttctcgtcggacctaccgtaagttcngggaccgtacgccggtccctcccgtagtcccgttctcgtgggcccttacccgagtcgtaggaggtacgtgaggtcctagtaacttactttacgacgtactaactctaattagtcgaccgagggaccgttacgaaccgtttcgggttggggttcggttacggggacgggacgggaacctaggctacgaccgttcgtacggcaacggacccgaaggccncgtccccggtgtaccacttctccccg

SEQ ID NO: 343389 - DNA, 556 bp, Homo sapiens
  misc_feature: GZ8MTXP02FPMNS.22.21.B10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (530)..(530): a, c, t, g, unknown or other
  misc_feature (530)..(530): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctccgtggacagtcagtcaccatctcctgcactggaaccngcagtgacgttggtgtacagtntgtctcgtgtaccaacaccaccagcacacgacccccaaatccatgatttangagtcacgtaagcggcctcgacgggtccctgactcgcttctcgtcgacctccagtctggacacnccggcctaccctgacctctcgngggcctccgagctggaagntggagctagtatttacgtntcgtactactatatagtcgacgaggccgatacgttcgttggggtcgtacgggcgggaacggaccaggtctacggaccgttccgtagccgacggacccgaaggtccgttcccncccgttcggactaccgtcgtaccccg

SEQ ID NO: 343390 - DNA, 628 bp, Homo sapiens
  misc_feature: GZ8MTXP02JNND7.22.21.B10.1.454.CMB.2.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatctcctgcactggaaccngcagtgacgttggtgtacagtntgtctctgtacacaccaccagcacacgccccaaatcatgtatttangagtcacgtagcggtcctgacgggtccctagacgtcgcttcgtcgtcgcctaccgagttcgtggaccgtaccgccggtccctaccgtcggacccgttcgtcgtacggggtcccttaccgaggtcccgttagggacggtagttcgggacgtcgttacggttaatttacttacgtcggtacctacttacaacgtttagcggacgtacgggccgtacttaacgttcggttggggtcgttcgggacggaacgggtaccctaaggtcctacggtaccgttacgttacggccgacggaccgtaagggccctaccggccccgttcggtacctcccgttctttccccgg

SEQ ID NO: 343391 - DNA, 575 bp, Homo sapiens
  misc_feature: GZ8MTXP02IY0LL.22.21.B10.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
tcagacatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccngcagtgacgttggngtacagtntgtctctgtaccacacaccagcacagccccaactcatgatttangaggtcacgtaagcggcctcgaggggtccctgactcgtcttctcgtcgctccaagtctggcgacncggcctccctgaccctctcgtgggctccagctgagntgagctgtattaacttactgtacttactacgtattatcgacgaggccggactaacgttcgttgggtcggttacgggcgggacggtaacccgaagccgtacggaacccgttacggttacgacccgaacggacccgaaacggtccgttcccgaccccccggttacgtcccgtaaccgttccgtttccccgg

SEQ ID NO: 343392 - DNA, 601 bp, Homo sapiens
  misc_feature: GZ8MTXP02HSA0I.22.21.B10.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (371)..(371): a, c, t, g, unknown or other
  misc_feature (371)..(371): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagcctccctccgcgtccgggtctcctggacagtcagtcaccntcctcngcactgaaccagcagtgacgttggtggttanaagtntgtctctgtaccaacaccaccgngcacacgaccccaaatcatntattangagcagtacgcggcctacgagggtccngatccgtcttctctcggctacgtatcgtgaccgacgccggtccctccngtacccgttctcggtacggtccctccgaggtccgtaggaggtagtgggtacggtacttagtaatttaacgttacgtcgtaccttaatctaattagtacgacgacgggccgacgtaacgttcggtgggttacggtcgggacggaacggacgacgtcgtacgtaccgtaccgtacgacgacccgacgtaacggccgtacccgtccccgtcgtaccctccgttcccgttcccg

SEQ ID NO: 343393 - DNA, 650 bp, Homo sapiens
  misc_feature: GZ8MTXP02JS9F6.22.21.B10.1.454.CMB.2.raw
  modified_base (222)..(222): a, c, t, g, unknown or other
  misc_feature (222)..(222): n is a, c, g, or t
  modified_base (244)..(244): a, c, t, g, unknown or other
  misc_feature (244)..(244): n is a, c, g, or t
  modified_base (470)..(470): a, c, t, g, unknown or other
  misc_feature (470)..(470): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccggtctcctggacagtcagtccaccatctcctgcactggaaccngcagtgacgttggtgtacagtntgtctctgtaccaacaccaccaggcacacgacccccaaatcatagtattatgacgtacaacgtaaggccggcctcggacggggtccctagactcgtcttctcgtccggtcctaccgtaagtcgtacggccgtacgacccggtccctaccggtcgtaccgtcgtcgtcggcctccgaggtctacggaggacttcgggaacggtcgtaagtaactttacttaccggtntaccttacctagtattaacgcgtccgaacgggtccgaacttaacgtttcgggttgggttcggttaccggggacgggacggtaacccgaacggttccgtaaacggtcccggttacgtacggtacccgacggacccgtaacgtccgtacccgtccccgtacggtacctcttcccgttccccg

SEQ ID NO: 343394 - DNA, 581 bp, Homo sapiens
  misc_feature: GZ8MTXP02HK2CY.22.21.B10.1.454.CMB.2.raw
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctggcccagtctgccctgactcagcctcctccgcgtccgggtctcctggacagtcagtcaccatctcctgcactggaaccagcagtgacgttggtgtacaagtntgtctctggaccaacaccaccagcacacgacccccaaancatcgtattngagtcacgtaagcggcctacgacggggtccctgactcgcttcgtctggcctacgagtctggaccacnccggcctccgtgaccgtctcgtgggcctcgaggctagaggtanagnggcttaggattatactagacttactcaattagcgcgaaggcgacgtaactcggttagggtcggttcgggacgggaacggtacccgaagtccgtcgaaccggttactacggtaccacggaacccgaaacgggtcctacccggtccccctacggtaccctaaccggtttccttcccccg

SEQ ID NO: 343395 - DNA, 663 bp, Homo sapiens
  misc_feature: GZ8MTXP02IZ9M2.22.21.B10.1.454.CMB.2.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacngtcagtcaccatccncctgcactggaaccngcagtgacgttggngttacagtntgtctctgtaccacnccaccagcacacgccccaaatcatgtatttangacgtcacgtaagccggtcctcgacggggtccctgatccgtcttcctcgtccggcctaccgtaagtccgtcgggccgtaaccnccgggtcccttcccgtacggtacccgttccgtcgtacggggcccttccgaggtcgtacgagggtacgtaggacggttccgtaaggttaactttacgttaccgtcgtaccttacgtactacgttacgtcggacgaacgggtccgacgttaacggttcgggttacgggggttcgttaccgggggacggtaacgggaaccgtacggtccgtacggtacccggtaccgtacgggtccaacggtcccaacgggtccctcccggtccccgtggtcctaccgttctttaccccg

SEQ ID NO: 343396 - DNA, 594 bp, Homo sapiens
  misc_feature: GZ8MTXP02FT0RW.22.21.B10.1.454.CMB.2.raw
  modified_base (295)..(295): a, c, t, g, unknown or other
  misc_feature (295)..(295): n is a, c, g, or t
  modified_base (424)..(424): a, c, t, g, unknown or other
  misc_feature (424)..(424): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccagcagtgacgttggtgttacagtatgtctctgtaccaacaccaccagcacacgacccccaaactcatgtatttangaggtacacgtaaggcggcctacgacggggtccctgactcgcttcgcttcggcctccgaagtccgtggaccgaaccgccgggtccctcccgtcgacccgtcgtccgtgggtcctccgagtctggaacgngtgagctagtatttatactcgtactactactatagtgacgaggccggactaacgttcggtttggggtggttaccggggacgggtaacgggaacgtaaacggtcgtaccggtaccgttacgtacggtaccacggtaccaagtcgctacccggccctcggtccgacttcccg

SEQ ID NO: 343397 - DNA, 586 bp, Homo sapiens
  misc_feature: GZ8MTXP02JCN8J.22.21.B10.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtntgtctctgtaccacaccaccagcacacgacccccaaatcatgtatttangacgtcacgtaaggccggtcctcggacggggtccctagactcgtccttctcgtcgcctacgagtcgnggaccgacnccggtccctcccgtgacccgttctcgtcgggcctaccgaggtctggagntggacgcttagtacttacttacgtcgtacttactatattagtcggacgacggcgtactacgttcggttgggtcgtcgggaggacggactagccgtcgtaccgtacgtacggtccacgaccgaaggtccctaccggtcccccgttaggtcctacccgttcgttaccccg

SEQ ID NO: 343398 - DNA, 624 bp, Homo sapiens
  misc_feature: GZ8MTXP02FHD54.22.21.B10.1.454.CMB.2.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgccactggaaccagcagtgacgttggtggttaacaagttatgtctctggtaccaacacccacccaggcacacgacccccaaactcatgatttangagtcactagcggcctcgagggtcccngactcgnttctntcggctccaagtctggaccgacgtccggccctccctcgtacccgtatcgtcggggtccttccgacggccttagggaggatggagggctaggtatttattaacgtgtacctactcgtaactagtcgcgagggtccggactaacgttccggtttggggtcggttccggggaggggaaccgggaccgtaacggccgttaccggtaccgttacccggtacggttaccgaccgacccgaaggtcccttaccggccccccgtcgggtacctccgtccgtttaccccgg

SEQ ID NO: 343399 - DNA, 582 bp, Homo sapiens
  misc_feature: GZ8MTXP02I4HYK.22.21.B10.1.454.CMB.2.raw
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
  modified_base (448)..(448): a, c, t, g, unknown or other
  misc_feature (448)..(448): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcacntctcctncactggaaccngcagtgacgttggtgttacagtatgtctctgtaccaacaccaccaggcacacgacccccaaactcatgtatttangagtcacgtaagcggctcgacgggtccngactcgtcttctctcgctacagtctggccacgccggtccctccgtcgacccgtctcgtcgggcctaccgaggtcgtaggacggtagtggacggtctagtaactttacttacgtgtaccttactntacgttatcggacgtacggcgactacgttcggttgggtcgttcgggacggtacggtaaccgagtccgtacgacccgtcgtacggcgaccgaccgaacgccctcccggcccctggtacctccgttcgtttccccg

SEQ ID NO: 343400 - DNA, 556 bp, Homo sapiens
  misc_feature: GZ8MTXP02H78W1.22.21.B10.1.454.CMB.2.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctggcccagtctgccctgactcagcctccctcgcgtccggtctcgtggacagtcagtcaccatctcctgcatggaaccagcagtgacgttggtgtanagtangtctctgtaccacaccaccagcacacgacccccaatcatgtattangagtcaacgtaagcggctcgagggtcctgatcgtcttctctcggctaccagtcgtgcgacncgtcccttccngtaccctctcgtgcctccgagctggacgtagngagtcgtagtattacttacgtacgtactactactatagtagacgacgacgtacgtacgttcggttcggttcggtacgggtacgggacggacgacgtacgtacgtacgtacgtacgtacgacgaccgaacgtccgtcccgtcccgtccgtccgtccgtaccgtcccg

SEQ ID NO: 343401 - DNA, 658 bp, Homo sapiens
  misc_feature: GZ8MTXP02G6IGW.22.21.B10.1.454.CMB.2.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagccctccctccgcgtccggtctccgtggacagtcagtcaccntctcctgcacgtggaaccngcagtgacgttgtgtacagtntgtctcgtgtaccacaccaccagcacacgaccccaatcatagtattangagtcacgtaaggccggtcctcgacgggtccctagactccgtctcgtcgtcggtcctaccgtaagtccgtcggaccgacctcccgggtccctacccgtccggtacccgtccgttcggcgggtaccctcccgaggtccgtaggaggtagtcgggagtcttagttaattacgttacgtcgtacttaacctgtaacgtagcgtacggacggtccgtacgtacggtttcgggttcggggttcggtacgggacgggaacggtaccgtacggtccgtaccggtacccggttacggtaccgaccgtaccggacccggtaacggtccccgtacccggtccccgtaccgtacccgtaccgttcccggttaccccg

SEQ ID NO: 343402 - DNA, 592 bp, Homo sapiens
  misc_feature: GZ8MTXP02GWBXN.22.21.B10.1.454.CMB.2.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcacgcctccctccgcgtccgggtctccgtggacagtcagtcaccntctcctgcacgtgaaccngcagtgtacgttggtgttacagtntntctcngtaccacaccaccagcacacaccccaaatcatagtatttangacgtacacgtaacgcggtcctacggacgggtcctgtactctctctctccggtcctaccgtagtcgtacggccgacgcccgccctccgtcgtacccgtctcgcggcctcgcgctgaggtangngtcgtagtattactacgtntactactnaacttnagtcggagccgacttagtcggttcgggttcggtcgggaggtacggaacgtacgtacggtcggtaacccgtcggttacggaccgaccgtacccggaacgtcccgtcccgtacccgtcggtaacctccgtccctttccccgg

SEQ ID NO: 343403 - DNA, 666 bp, Homo sapiens
  misc_feature: GZ8MTXP02JS8OX.22.21.B10.1.454.CMB.2.raw
  modified_base (224)..(224): a, c, t, g, unknown or other
  misc_feature (224)..(224): n is a, c, g, or t
  modified_base (312)..(312): a, c, t, g, unknown or other
  misc_feature (312)..(312): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcgagggcacgagggtcctgggcccagtctgccctgactcagccctcctccgcgtccgggtctccgtggacagtcagtcacatctctgcacgtggaaccngctaggtgtacggttggtgtaacagtatgtcctcgtagtaccaacacccaccgaggccacacccgacccctaaatcactgtatttagnggaacgtacaacgtaacggccggtaccgtacggtacgggtcctagtacgttccgtcttcgtcgtcgtacctaccgtagtccgtacggaccaaccgtcccggtccctcggtaccgtccgtcgtcgtcggaccctcgaggtctacggagtcgtaggtacgtagtacgttattacgttacgtacgtacttactacgtagtacgtcgacggaacggtccgtacgttaaccgttgggttacggggtcggtaccgggggtcggaacggtaacccgtggtccgtaccggtaccgtacggtacgaccgaccggacgcggtcccgtacccggtcccgtaggacccttaccgaccgtttccccg

SEQ ID NO: 343404 - DNA, 688 bp, Homo sapiens
  misc_feature: GZ8MTXP02G2NQB.22.21.B10.1.454.CMB.2.raw
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatctcctgcactacggaaccagcgagtgtacggttggtaggttacaagtatgtctctaggtaccaacaccacccgagccacaccgaccccaaatcatagtatttangagtcaactacgcgcctagacgggtcngctcgtntctntcgcctacagtcgtcgaccacgccggtcctccgtacgcccgttcgtccgtcgggtccctccggaggtctaggaggacgtggacggttntaggttactttagttacgcgataccgtntactagttaggacgggacgacgtaacggtacgttaaacggtttaggtttcgggggttacggggttacccggggacgggggtaaaacgggtacccggtaaacggttcccggtaaaccggttacccggttaaccggttaccgggacccgtaaacccggtcccggtaaaccggtcccccggtacccggttccccccgtaagggtttccccctaaccggtttcccccgg

SEQ ID NO: 343405 - DNA, 551 bp, Homo sapiens
  misc_feature: GZ8MTXP02HSH39.22.21.B10.1.454.CMB.2.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (406)..(407): a, c, t, g, unknown or other
  misc_feature (406)..(407): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagccctccctcactcagggcacagggtcctgggcccagtctgccctgactcagccctccctccgcgtcccgggtctcctggacagtcagtcaccatcctcctgcactggaaccagcagtgacgttggtgttacaagtatgtctcgtgtaccacaccaccagcacacacccccaaatcatntatttatgagtacactaagccggctcgagggtccctgancgtcttcncgtggcctcgaaagtcaggaccgacaccggtcccttccaggcctctccgtgcctccgagcagaagnngagntntatatactctactatatatagtagagaggcgacgtacgtcggttggtcggtcgggtacggaacggacgacgtacgtacgaccgtacgtacgtaccgacgaccgaaccgcgaccgtcccgccgtacctaccgtcgtccg

SEQ ID NO: 343406 - DNA, 568 bp, Homo sapiens
  misc_feature: GZ8MTXP02IFSVI.22.21.B10.1.454.CMB.2.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (288)..(288): a, c, t, g, unknown or other
  misc_feature (288)..(288): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccagcagtgacgttgtgttacagtngtctctgacanaccaccagcacacgacccccaaatcatagatttangaggtacaactaaagcggtcctacgacggggtccctgatccgtcttctgtccggcctaccgaagtcgtggaccgacaccggccttcctcgtacccgtcttcgcgggccctccgaggctaggagagtgagtgtagtattattactacgtactactactatagtagacgagcgacgtacgttcggttggttcggttcgggtacggacggacgacgacgtacgtaccgtacgtacgtacgacgaccgaacgtcgtccgtcccgtccgtccgtaccgtcgtccg

SEQ ID NO: 343407 - DNA, 609 bp, Homo sapiens
  misc_feature: GZ8MTXP02JU0FE.22.21.B10.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcacgccctcctccgcgtccggtctcctggacagtcagtcacatctctgcactgaaccngcagtgacgttggtgttacattngtctctgtaccacaccaccagcacacgaccccaaatcatagtatttagngtagtacacgtaacggcggcctcgaccgggtcctagtactcgtctcgtcgtcgcctacgagtcgtggaccgacgcccggtccctaccgtcgtaccgtcgtcgtcggcctcgaggtctaggacggtgtcggacggtcgtagtaactttacgttacgtcgttactacttaccgattacgcgtacgacggaccgtacgtaccgtttgggtcggggtcggttacgggacggtaacggaccgtacgtcgacggtcctaccggtagaccgaccgaccgaacggtcccgtaccccgtacccgtcggtacctaccgttcgtcccccg

SEQ ID NO: 343408 - DNA, 657 bp, Homo sapiens
  misc_feature: GZ8MTXP02HIJLY.22.21.B10.1.454.CMB.2.raw
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaaccagcagtgacgttggtaggttacaagtatgtctctaggtaccacaccaccagcacacgaccccaatcatgtatttatgagtacaacgaaggccggcctcggacgggtccctgactcgtcttctcgtcggtcctacgacgtcgtcggaccgacgcccgggtcccttccgtacgtcccgttcgtcggtcggtcctccgaggcgttggaggtacgtggagttcctagttaactttagttacgtacgtacttactactaattgtacgacggacggtcgtacctaacggtttgggttacggggtcggttacggggacggggaacggtaaccgtaggtcggtaccggtaccggttaccgtacggtccgaaaccggtcccggtaaacggtcccgtacccggtccccgttaccggttacccaccggtttcccgtttcccccgg

SEQ ID NO: 343409 - DNA, 725 bp, Homo sapiens
  misc_feature: GZ8MTXP02HYEZP.22.21.B10.1.454.CMB.2.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctcctcgcgtccggtctcctggacagtcagtcacatctcctgcactggaaccngcagtgacgttggtgttaacaagttntgtctcgtgtaaccacacccaccgaggccaacaccgaccccaaagtccaatgtaatttatggacgtacaacgtaagcgggcctacggacgggtccctaggacttccgtacttcgtcgtacggtacctaccgtagttccgtaggaccgtaaccgaccggtccccttaccgtcgtaaccccgttcctaccggtcggggtccctaccgtacggtacgttcgggaacgggtagttacgggaacggttccgttaaggtaacgtttttaacgttacttacggtaaccttaacgttacttaaacgttagttaccgacgtacggggaccgttacgtaaaccgttccggttaggggtttccgttcgggggacgggtaaacgggaccctaaaggccgttacggaccggttaccgttaacggccgtaaccgacccgtaaacgggtacctaccccggtcccccgttcggtaaccctccgttttacccgtccccg

SEQ ID NO: 343410 - DNA, 706 bp, Homo sapiens
  misc_feature: GZ8MTXP02GMN8A.22.21.B10.1.454.CMB.2.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
  modified_base (477)..(477): a, c, t, g, unknown or other
  misc_feature (477)..(477): n is a, c, g, or t
tcagacatacgcgtcacgaccggtgctcgatttagtgtcgtcgcaagggggggggtctcagggaggcagcgctctcaggacgtcaccaccatggcctgggctctgctcctcctcagcctcctcactcagggcacagggtcctgggcccagtctgccctgactcacgcctcctccgcgtccggtctccgtggacagtcagtcacntctctgcactggaaccngcagtcgtacgttggtagttaacagttntcggtcctcgtacgtacccaacacccaccaggcctacgaccgacccccaaatccgatacgtatttcgaggtacgtctaacggtaacggccggtacctaccggtacggggttccctaggtacgttcgtacttccgtacgtcccggcctaccgtagtccgtagggaccctaacgcccgtcccttaccgcgtaccgttcctacggtcggtacctccgagtccgtggacgtntacggcgtacgtgttaagtttacttacgtcgtacctacctagtacttacgcggacgtacgggtaccgtaacgtaacggtttcggggttacgggtacgggttaccggggacgggtaaccgggtacgtaaacgggtccggttacggtaaacccgttccggtaacggtacccgacggtaaccgcggtcccgtacccggtccccgtaacgtcccctcggttacctttcccccg

SEQ ID NO: 343411 - DNA, 625 bp, Homo sapiens
  misc_feature: GZ8MTXP02GZXOL.22.21.B10.1.454.CMB.2.raw
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccagcagtgacgttggtgttacagtatgtctctgtaccacacaccagcacacgccccaaactcatgatttangacggtcacgtaagcggcctcgacgggtccctgactcgtcttctctcgtctcctaagtctcgcgacncggcctcctcgaccgtctcgtcgggcctccgaggtccgtaggacggtatggtacggtcctaggtactttaagttaccttggtaccttaacgtcctaagttaacgttcggacgtacggggacccggtacgtaaacgtttccggttagggggttcggtttaccggggacggggtaacgggtaaccgaacggccgtacggtaccgtaccggtcggtaccgacgacccgaacggtccgtaccggccccgtacggtcctaaccgttcgttccccg

SEQ ID NO: 343412 - DNA, 703 bp, Homo sapiens
  misc_feature: GZ8MTXP02FJDCT.22.21.B10.1.454.CMB.2.raw
  modified_base (315)..(315): a, c, t, g, unknown or other
  misc_feature (315)..(315): n is a, c, g, or t
  modified_base (457)..(457): a, c, t, g, unknown or other
  misc_feature (457)..(457): n is a, c, g, or t
  modified_base (504)..(504): a, c, t, g, unknown or other
  misc_feature (504)..(504): n is a, c, g, or t
  modified_base (677)..(677): a, c, t, g, unknown or other
  misc_feature (677)..(677): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactcggaaccagcagtgtacgttggtgttaacaagtatcgtctctaggtaccaacacccaccaggccaccaccgacccccaaactccacgtagtaacttttancggtaacgtaccaacgttaacggccggggtaccctacggtaaccggggtcccctaggtactccgtcttccgtcgtccgtcctaccagttcgtacgccgactccgggccctccgtacgtaccgtctcggtcgggtcctaccgnggtccgtggaggtagtacggtacggccttagtactttaagtaccgtntaccgttacctactattacgacggtaccgggacggacccggtacttaaccgttacgggtttcggggtcgggtttaccgggggaccgggtaagggaccgtacgcggtaccgtaacccggtcgtaaccgggtacgaccgacccggtaacggccttaccccggacccccgggttancccgttaccgtcccgtttacccccgg

SEQ ID NO: 343413 - DNA, 576 bp, Homo sapiens
  misc_feature: GZ8MTXP02IVGZY.22.21.B10.1.454.CMB.2.raw
  modified_base (222)..(222): a, c, t, g, unknown or other
  misc_feature (222)..(222): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacagtatgtctctggtaccaacaccaccaggcacacgacccccaaatcatgtatttanggtacgtacaacgtaacggccggcctcggacggggttccctagactcgtcttctcgtcgctccagtcnggccacncggtcctaccgtgacccgtctcgtcggcctcgngctgagangagctagtattatacgngtactacgtctatntcggcgaggccgtactaacgttcgttacggggttcggttacgggcgggaacggaacgagtcgtacgtaccgtcgtacggtccgacgaccgaaggtccgccggtccccgtacgtcctacgttccgttaccccg

SEQ ID NO: 343414 - DNA, 595 bp, Homo sapiens
  misc_feature: GZ8MTXP02GT6UQ.22.21.B10.1.454.CMB.2.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagacatacgcgtcacgaccggtgctcgatttagtgtcgtcgcaaggggggggtctcaggaggcagcgctctcgggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctgtacacaccaccngcacacgacccccaaatcatgtatttangagtcaactaaggcggcctcgacgggtccctgactcgcttctctggcctaccagtctggcaccgacgccctcccngtacctctcgtggcctcgagctgagatgngctgattatctgctaactctatacgtgacgagggaccgacgtacgttcggttggggttcgttcggggaacgggacgggaaccgtaaacgtcgtaacggtacccgtaccgtaacggtaccgaaccggacccgtaaacgggccgtaccccgtaccccccgttcggaaccctaccgttaccgtttcccgtttaaccccccg

SEQ ID NO: 343415 - DNA, 595 bp, Homo sapiens
  misc_feature: GZ8MTXP02GH4RE.22.21.B10.1.454.CMB.2.raw
  modified_base (246)..(246): a, c, t, g, unknown or other
  misc_feature (246)..(246): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagacatacgcgtcacgaccggtgctcgatttagtgtcgtcgcaagggggggggtctcaggaggcagcgctctcaggacgtcaccaccatggcctgggctctgctcctcctcagcctcctcactcagggcacgagggtcctgggcccagtctgccctgactcagcctccctccgcgtccgggtctcctggacagtcagtccacatctcctgcactggaaccagcagtgacgttggtgttacagtntgtctctgaccacaccaccagcacacaccccaaancatagatttangagtcacgtaaggcggcctcgacgggtcctgactcgtctctcgtcgctacagtcgtgaccacgccggtcctccgtcgaccgtcgtcgtcggtcctaccgagtcgtcggaaggtcgtaggacggtcttaagtactttagtacgtcgtacttactacgtatagtcgacgaggtacgtacgtacgttcggttcgggtacggttcgggacggtaacggacgtacggtccgtacggtacccgttacgtacgtcgaccgaccgtaacggtcctaccggtaccccgtcgtaccgtaccttcgttcccccg

SEQ ID NO: 343416 - DNA, 557 bp, Homo sapiens
  misc_feature: GZ8MTXP02IMQQ6.22.21.B10.1.454.CMB.2.raw
  modified_base (287)..(287): a, c, t, g, unknown or other
  misc_feature (287)..(287): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
tcagacatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtcccgggtctcctggacagtcagtcaccatcctcctgcactggaaccagcagtgtacgttggtggttacagtatgtctctgtaccaacaccaccagcacacgacccccaaancatagtatttatggtaggtaccacgtaaggccggtcctcgacggggtccctgacgtccgtcttctctcggcctaccgagtcgtggaccgacnccggcctccctcgacccgtctcgnggccctcgagctggagngtgagtcgtagtattactactgtactacttctatagtcgagacggtcgactacgttgtgggtacgtcggacggtacggactagcgtacacggtctagcacgccgaagccgtacgccccgtgacctcgtcgttccccg

SEQ ID NO: 343417 - DNA, 380 bp, Homo sapiens
  misc_feature: GZ8MTXP02G9AJN.2.23.C01.1.454.CMB.2.raw
  modified_base (362)..(362): a, c, t, g, unknown or other
  misc_feature (362)..(362): n is a, c, g, or t
  modified_base (368)..(369): a, c, t, g, unknown or other
  misc_feature (368)..(369): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
tcagacgctcgacacacgaccggtgctcgatttagtacacgtgattagggattggggtacgatttaatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaaacatacgccttcctcccgtcccccttcgcacgtaacaccaagtacaaggaatacttaacctgttcccatcgactacgccttcggcctcgctagggtcactcacctgccccgtattaacgtggacacggaccttggtctcggnagcggnngnaagcnangn

SEQ ID NO: 343418 - DNA, 669 bp, Homo sapiens
  misc_feature: GZ8MTXP02JRNDY.2.23.C01.1.454.CMB.2.raw
  modified_base (451)..(451): a, c, t, g, unknown or other
  misc_feature (451)..(451): n is a, c, g, or t
  modified_base (645)..(645): a, c, t, g, unknown or other
  misc_feature (645)..(645): n is a, c, g, or t
tcagacgctcgacacacgaccggtgctcgatttagtacacgtgattagggattggtgcccaagctgctggagggcacggtcaccacgctgctgagggagtagagtcctgaggactgtaggacagccgggaaggtgtgcacgccgctggtcagggcgcctgagttccacgacaccgtcaccggttcgggaagtagtccttgaccaggcagcccagggccgctgtcgcccccagaggtcgctcgttggaggagggtgccgaagggggaacgaccggagtgggcccttgggtggaggcgtggaggacgacgggtgaccgtagggttccccgtgggcccccgtaggggtccgaaagtccgaaccgtgctagtaccggcctcgtcgacacaaataatacgacagtccgtagtccgcgtacgtccaacgacgaaacctcgaacgcctacgaaggganaacgttcggttccgtagggtacttggtacgtaccgtaggtaacgttaccgggtaccgaacccgtaccgttcccggtagggtacggggtacgggtttaggtacggtttgggtcgtccgttccgtacgttaacgtccttaagttcgaacgtttcgacgtactaacgttacccaccttaccgaccgtaccccgacgnggccggcgacgcgacgcgacgtaa

SEQ ID NO: 343419 - DNA, 530 bp, Homo sapiens
  misc_feature: GZ8MTXP01DX7ZQ.13.71.G05.1.454.CMB.2.raw
  modified_base (329)..(329): a, c, t, g, unknown or other
  misc_feature (329)..(329): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccccccttagacgntctctcggctccactctcggaacgacacgcactctgaccatcgagcgggacccacggcgtcgnggangagccgtgggactattactgtcgaggcgtgggacncgcagcnctaagccttccgttacggaacgtacgggtaccgaacggttccgaccgtcccgtaggtccgaccgccgaacgggtcccgaaccccgtaacccg

SEQ ID NO: 343420 - DNA, 522 bp, Homo sapiens
  misc_feature: GZ8MTXP01CTV71.13.71.G05.1.454.CMB.2.raw
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaacctatggcatgcactgggtccnccaggccccaggcaagggggctggagtggctgactctttancatatgatggaagtacaaaaattctaatgcagactccgagaagggccattcaccgtctccagggacaactaccaagaacaccttanatctgacaggatgaaaccagcctgagaggtagacgactcggntcgtaatacttctgttgacgacaaacgnttagaatgtttgggagtgggttatggttgtttaacc

SEQ ID NO: 343421 - DNA, 618 bp, Homo sapiens
  misc_feature: GZ8MTXP01DQZ5R.13.71.G05.1.454.CMB.2.raw
  modified_base (500)..(500): a, c, t, g, unknown or other
  misc_feature (500)..(500): n is a, c, g, or t
  modified_base (527)..(527): a, c, t, g, unknown or other
  misc_feature (527)..(527): n is a, c, g, or t
  modified_base (586)..(586): a, c, t, g, unknown or other
  misc_feature (586)..(586): n is a, c, g, or t
tcagtcacgtactacacgaccggtgctcgatttagtgtcgtcgcaagagagaggagcccagccctggactccaaggcctttccacttggtgatcagcactgagcacagaggactcaccatggaattggggctgagctggtttccttgttgctatttagaggtgtccagtgtgaggtgcagctggtggagtcgtgggggagcttggtccagccgtgggggtccctgagactctcctgtgcagcctcgtggtattcacctttagagctagtggatgagtcgtgggtcccgccgaggcctaccggagggggaagggctgggaggtggggtggacccaaagaataaagctaaaggttaggaagtagaaagaaattacgtaagtgtggaaaccttgtgggtaggaaacggggtccctaattccaactatcctaccaaggaacgaacaaaccgcctaaaaggaaaccttcaacgttgttaactcgtagaactaaaatgggaaaccnggcctagaggacgccggaggtaaaccncggtctagttctaagttaactggttgacgaggaggtcggtttaggggcggttaaaagtntaaaggcgtaggcggactaacgttcgttaacg

SEQ ID NO: 343422 - DNA, 532 bp, Homo sapiens
  misc_feature: GZ8MTXP01DODCP.13.71.G05.1.454.CMB.2.raw
  modified_base (337)..(337): a, c, t, g, unknown or other
  misc_feature (337)..(337): n is a, c, g, or t
  modified_base (418)..(418): a, c, t, g, unknown or other
  misc_feature (418)..(418): n is a, c, g, or t
  modified_base (491)..(491): a, c, t, g, unknown or other
  misc_feature (491)..(491): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctctggattcagcttcagaacctatggcatgcacgtgggtccgccacggcccccaggcgaagggggctgggagtggctgacttctttancatatgataggaagtacaaaattcatgcagactcgtagaagggccatcaccgtctcgaggacaactaccaagaacacctanatctgcaggatagaacagcctgagaggtagacgtacgtcggctggtaatacttcgtgttcgacgaacaaacgnttagtaagttggtttgggaggttggagttgttgtttaaccc

SEQ ID NO: 343423 - DNA, 545 bp, Homo sapiens
  misc_feature: GZ8MTXP01ACUHL.13.71.G05.1.454.CMB.2.raw
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaaggccagtcccctgtgctggtcatctatcaagataccaagcgcctcagggactcccccttagcgatctctggctccaactctgggacgacacgcactctgaccactcacgcgggacccacggctgtggatgagngtacgggatagttactacggttnaaggcgtgggacgngcacggcnctaacgccttcccgtttcggaacgtacggggtaaccaaacgggttcgaccccggtcctttacgggtccgacgaccccgaaccgggaacccgaacccctaacccg

SEQ ID NO: 343424 - DNA, 633 bp, Homo sapiens
  misc_feature: GZ8MTXP01B7RIO.13.71.G05.1.454.CMB.2.raw
tcagtcacgtactacacgaccggtgctcgatttagtgtcgtcgcaagagagaggagcccagccctgggattttcaggtgtttcatttggtgatcaggactgaacagagagaactcaccatggagtttgggctgaactggtctttttcttgtggctattttaagaggtgtccagtgtgaggtgcaactgttggagtcgtgggggaggcttgggttcaggccgtggggggtccctgagactctcgtgtgcagcctctggtatttagtttagcagttatgccatgagctgggtccgcaggctccgagggaaggggctggaggtggggtttcgggtattaggtgctcgttgatgatagcacatactatgcagaactccgtaagggcctctcaccatctccagagacaattaccaaagaaccacgactatatctgacagatagaacgaggccgtggggaacgcccggaagggaacccgtaccgggtaccgttttaacgtccgtaaccgttgggtacggtaaccggaaaaagttagtttaagtttaaggttaaagttggttaaacggtttgggttaaacggtcttaggtccctttaaaccgttacctttaacgttttttcgaaccgttttaacccgggg

SEQ ID NO: 343425 - DNA, 512 bp, Homo sapiens
  misc_feature: GZ8MTXP01CKEJ0.13.71.G05.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcgtgggggagcgtggtccagcctggggaatccctgacactgtctgtgtagcctntggattcagcttcagaacctatggcatgcacgtcgggtcccnccgacggcccccaggcgaagggggctggagtggctgacttctttancatatcgataggaagtacaaaaattctaatgcagactcgtgaacgggcatcacgtcncgaggacaactacaanaacactanatctagcaggatagaacagcctgagagtagacgtacgtcggctgtaatacttntgttgacaacaaanttgaatgttgagtgatgttgttaac

SEQ ID NO: 343426 - DNA, 573 bp, Homo sapiens
  misc_feature: GZ8MTXP01ALMYS.13.71.G05.1.454.CMB.2.raw
  modified_base (441)..(441): a, c, t, g, unknown or other
  misc_feature (441)..(441): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggtatttagtttagcagttatgccatgagctgggtccgccaggctccgagggaagggctgggagtggggtttcgggtattagtgctcttgatgatagcacatactatgcagaacctcggttaagggcccgcttcaccatctaccagacgacaattaccaaagaaccacgactatatctgcagatagaacngcccgtgggacgccggaaggaccgacggtaccgttatccaacgtggtagaacgaaagttattagttagtaaagtgttaagttgggttagtcgtagtcctaacttacttacgtttttcgaacgttaaccgggg

SEQ ID NO: 343427 - DNA, 604 bp, Homo sapiens
  misc_feature: GZ8MTXP01CIRYC.13.71.G05.1.454.CMB.2.raw
  modified_base (337)..(337): a, c, t, g, unknown or other
  misc_feature (337)..(337): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagtcttacagaacctatggcatgcactcgggtcccgccaggcccccaggcgaagggggctggagtggctgacttctttantatatgagtaggaataactaaaattctaatgacaacgtaccgtacggaggaacgggtcctacttaccgaccgtccgtaccgaacggaaccaaacctaccaaacgtaaacctaacttaatactacgtacgacgaaggatacgaaacgacgaccgtaggacggtacggtacgaaccgtacgtcggtactacgttaacttacgttcgtagttacgtaacgaacaaacgttgttagtaagttggttaaggagtggttactgttaacgtaac

SEQ ID NO: 343428 - DNA, 588 bp, Homo sapiens
  misc_feature: GZ8MTXP01EIQPB.13.71.G05.1.454.CMB.2.raw
  modified_base (378)..(378): a, c, t, g, unknown or other
  misc_feature (378)..(378): n is a, c, g, or t
  modified_base (463)..(463): a, c, t, g, unknown or other
  misc_feature (463)..(463): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggacagaataaatatacttctgtatcagcagaagcagccacgccccctgtcctactcattctttacaaaactaccgagggccggtccccttcggtcgggggtcccctggacggccgtattccccgtcccggctcccggcctcgtaacgggaacncgagtccactctacgaccatcgagtcggacccagctattgagtggagtctagtctacttcgtgtcggaggtcggtaggaacacgngcgtgtcgttcggtcgggacggtagggcctaaggtccgttacggtaccgttcgtaacgggtcgaacggcccgaaggtcccgtccgcccccgtcggtaccttaccgttcccgttaaccgttccccc

SEQ ID NO: 343429 - DNA, 581 bp, Homo sapiens
  misc_feature: GZ8MTXP01AE1XM.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatgcttgctggtatcagcagaagccaggccagtcccctgtgctggtcatctatcaagatcgaccaagccggccctcgacgggacctcccgtgacgcgtattcctcgtggcctcccaacgttccgtacggggaacttcgacgccctactcctagaacccatccgaacggccgggacccagggcctagtggaatggacggggtctaggactagtttaccgtgtacgagggtcggtagggacacggcaagcaacgttcggccccgttattacgtcggttccgttccgggaacgttcggggaacctaacgggtcccgacccggttaccgtaacgttccgaaccccggg

SEQ ID NO: 343430 - DNA, 558 bp, Homo sapiens
  misc_feature: GZ8MTXP01B8A6C.13.71.G05.1.454.CMB.2.raw
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (496)..(496): a, c, t, g, unknown or other
  misc_feature (496)..(496): n is a, c, g, or t
  modified_base (517)..(517): a, c, t, g, unknown or other
  misc_feature (517)..(517): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtggggggtccctgagactctcgtgtgcagcctctggtatttagtttagcagttatgccatgagcgtgggtccncaggctccgagggagggctgggagtgggttcggtattagtgctcttgatgatagcanactactatgcagaactccgtaaggcctctcacatcncaganacaactcaagacacgactatatcngacagaatcgaaacgacgcccgtaggggacgaccggacggaccgaccggttccgtttatcgacgtggtaggaacgaaagttnttattagtaagtgagttggancgtgtaaccttactacttacttttaagaacgttaaccgggg

SEQ ID NO: 343431 - DNA, 709 bp, Homo sapiens
  misc_feature: GZ8MTXP01A2K4R.13.71.G05.1.454.CMB.2.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagccgtggggaactccctgacactgtcttgtgtagcctctggattcagtcttcagaacctatggcagtgctacgtcgggtcccnccgacggccccaggcgaaggggctggagtggctgtacttcttttanctatagtgtaagtaggaaagttaactaaaaacttctaagtgaccgtaacggtacccgttccgggtaggtaacggggcctacgtttacccgtacccgttaccgtaccccggaaggggtaacccaaaccgttaaccccgaaaacgtaaacccttaaccccgtttaaattacttacccgtagaccgaaagggtaacgtaacggaaaccgtaacggtcccgtaagggaagggtaacgggttaacggaaccggttaaccgtcggtaccgttaggttaacttaaccgttcgtcggttacgaacgtaaacttaaacgttgttaggtaagtttgggttaaggtaggtaggttagttcggttaacgttaacccg

SEQ ID NO: 343432 - DNA, 710 bp, Homo sapiens
  misc_feature: GZ8MTXP01CG4JM.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctggagataaagttgggggaataaatatgcttgctggtatcagcaagaacgccaggccacgtcccctgtgctggcatctatacaagactaaccgaacgccggaccctacgacgggtacctccccccgtaggaacggtccgtaactttccgtccgttcgggtccctacccgtaaaccgttcggtaacggggaaaccaaccgacgacccctacgtccttacggaacccacgtacccgaacggggaccccggggtaaacccccgggtagggtccgtagggtacggtaagtacgggtacggtacggttaacggttaacgtttaacgtttaccggtacggtaccggtacggggtacggtacgggaaccgtacgacgtacgtcccgtaacgtccgttacccgttaccggttaacgggtaaccgtacgggaacccgttacggttcccgtaacccggttccgtaaccggacccgaccggaccccgtaacccgaaccccgtaaccccg

SEQ ID NO: 343433 - DNA, 560 bp, Homo sapiens
  misc_feature: GZ8MTXP01A06PX.13.71.G05.1.454.CMB.2.raw
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagccgtggggggtccctgagactctcgtgtgcagcctctggatttagtttagcagttatgccatgagctgggtccncaggctccgagggagggctggagtggggtttcggtattagtgctcttgatgatgcacatactatgcagaactccgtaaggccnctcaccntctcanagacaatcaagacacgctatatctgctagatgaacgagccgtgggacgccgaggacncgggtacccgttataccgtactggtnaacggtaaagnttagttacgtaaagtgaagttggttaacgtcgttcggtaacttaacctacgttaccgtttttaagaaccgttaacccgggg

SEQ ID NO: 343434 - DNA, 680 bp, Homo sapiens
  misc_feature: GZ8MTXP01AP6WA.13.71.G05.1.454.CMB.2.raw
  modified_base (558)..(558): a, c, t, g, unknown or other
  misc_feature (558)..(558): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcaggccgtggggggtccctgagactctcgtgtgcagtcctctggtatttagtttagctagttatgcatgagcgtcgggtccgcgaggctaccggaggggaagggctggggtaggttggggtttacggtattagtgcttctggatagatagcaactaagttactagtgacgaagtaacccgttaccgggttaacggggccctactttacccgaaccctacgttcccaccgtaagaacgaaactaacttaacccgaaagaaacctacgaccttataactcgtagacaaggtatacgaacgtacggccgtacgggacgaccggaacgacgtaaccggtccgtttaanaccgtacgttggacgtaacgtaaagttattaagttagtaaacgtggttaaacgttcgggttaatcccgttcggaacctttaaacgtacctttaacgtttttccgaacccgtttaacccgggg

SEQ ID NO: 343435 - DNA, 587 bp, Homo sapiens
  misc_feature: GZ8MTXP01EG87R.13.71.G05.1.454.CMB.2.raw
  modified_base (362)..(362): a, c, t, g, unknown or other
  misc_feature (362)..(362): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccgcaggctccagggaaggggctggagtgggtttcgggtattagtgctcttgatgatagcacatactatgcagaacncgttaagggacggcttcaccaatctccagagaacaatacaacgaaacaacactatatactgcagaatagaacgaacgaccgtcgggacggaccggacggaacgaccggtaccgtttacgttactactagtggaacgaaagaaagtaagtttaagttaaagtaagttagttaggttaggtaacgtgtaacgttaacttaacttacttttaacgtttaacgttaacg

SEQ ID NO: 343436 - DNA, 610 bp, Homo sapiens
  misc_feature: GZ8MTXP01BLP58.13.71.G05.1.454.CMB.2.raw
  modified_base (300)..(300): a, c, t, g, unknown or other
  misc_feature (300)..(300): n is a, c, g, or t
  modified_base (479)..(479): a, c, t, g, unknown or other
  misc_feature (479)..(479): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagcccaccctcagtgtcccgtcgtccccaggacagacagccagcatcacctgctctaggagagtaaagttgggggaataaatatgcttgctggtatcagcagaacgccgaggccacgtcccctgtcgctggtcatctanacaagactacgagccgcctagacggactccccgagacgcgtattcctcgtcggtcctaccaactcgtacgggaaccacgaccgtacccacttcgtacgaccacgtaccgacgggacccgggacccgaggtccgtggagagtaggacggtcttacggtacttaacgttacggtgtaccgngggtccggtaggactcggacgacggcaaccgtcgttcccgttaccggttacggaacggtcgggaaccgttacgggttcctaacccgtcgtaacggtaccaccggttacccgaaccggttcccctaaccccg

SEQ ID NO: 343437 - DNA, 604 bp, Homo sapiens
  misc_feature: GZ8MTXP01CQ1F2.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatgcttgctggtatcagcagaagccaggccagtcccctgtgctggtcatctatacaagataccaagccggccctcgagggactcccccgtgagcgattctctggcctccaactcgtagggaaccacagcccactctcgaccatcaggccgggacccaggctcgggaggatcggaggtcgtagtacttagttaccgtggtccgaacggggtcggtcggggaactacggcaacgggctaaccgttcggaccccgttcccggttacgggaaaccggttcggggaaaccccgttaacggggttccctaaccccggttccgtaacgggttcccgacggttaccccgaaaccgggttccccctaaaacccccg

SEQ ID NO: 343438 - DNA, 627 bp, Homo sapiens
  misc_feature: GZ8MTXP01DJOXQ.13.71.G05.1.454.CMB.2.raw
  modified_base (554)..(554): a, c, t, g, unknown or other
  misc_feature (554)..(554): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtggggggaggcttggttcaggccgtggggggtccctgagactctcgtgtgcagcctcgtggtattttagtttagctagttatgccatgagctgggtccgcaggctccgaggggagggctggggaggtggggtttcgggtatttagtgctcttgatgatagcactactactatgcagtaaccctacgttaaggggccctcttaccacctactcctcgaagacgaactaaattaccgaaagaaaccaacgtacttaattactactagacaagtatacggaaacgacggtaccggtaggggacgaccggaacggaccgacggttaccgtttagtcctacgtcggtagaacgtaaagttnttaaagttagtaaagtgagttcggaggtctagtaaccttaacgtacttacgttttaagaaccgtttaaccggg

SEQ ID NO: 343439 - DNA, 564 bp, Homo sapiens
  misc_feature: GZ8MTXP01EL9KD.13.71.G05.1.454.CMB.2.raw
  modified_base (288)..(288): a, c, t, g, unknown or other
  misc_feature (288)..(288): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccncaggctccgagggagggctgggagtggggtttcggtattagtgctcttgatgatagcacatactatgcagaactccgttaagggccgtcttcaccatctccagacacaatccaagaacacgactatatctagcagatgaaacgacgccgtggggacgccgaaggacgacggcccgttttaatcctacgtggtacgaagtaaagttattaagttagtaaagtggttacgttggttacgtcgtgtaacttacttactttacgttttaacgaacgtcgg

SEQ ID NO: 343440 - DNA, 588 bp, Homo sapiens
  misc_feature: GZ8MTXP01ETUQV.13.71.G05.1.454.CMB.2.raw
  modified_base (346)..(346): a, c, t, g, unknown or other
  misc_feature (346)..(346): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctggggttttcctcgttgctcttttaagaggtgtccagtgtcaggtgcagctggtggaatcgtgggggaggcgtggtccagccgtggggaactccctgacactgtcttgtgtagcctctggattcagtcttcagaacctatggcatgcacgtcgggtcccgccgacggcccccgaggcgaagggggctgggagtggctgtacttctttancatatgataggaatacaaaattctatgacagacctccggtaggaacgggctactcaccgtctaccgaggaaccaactaccaaagtaacctaccttatactctagacaaggatacgaaacacgacctaggaggaggtacgaccgtacgtcggtacttggtaacttacgttcgtcgttacgaaccgaaacttaaagttgttagttaagttggttaaggtaggtggttattgttaacgttaaccg

SEQ ID NO: 343441 - DNA, 656 bp, Homo sapiens
  misc_feature: GZ8MTXP01CNLQ5.13.71.G05.1.454.CMB.2.raw
  modified_base (450)..(450): a, c, t, g, unknown or other
  misc_feature (450)..(450): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctctaggagaataaagtggggaataaatatgtacttgcgtggtatcgagcaagacgccacggccacgtcccctgtcgcgtcggtcatacgtatacaagactaaccgaagccgcccgtacgacggactcccccgtggacgtcgtacttccgtacgtcggtccctaccgtaaacgtcgtacgggaacaccgtacgaccctaacttcgacgaccacgtaccgacgggacccgggaacccgngggtcctgggtagaagtggaacgggtcttagtaacttacgttacgtggtcgagggtcggtacgggaactcgggacaacggcctaacgtcccgttacccgtttacccggttacgggtaaacccggtagggaaccccgttaacgggttcccgtaacccggtccggttaacggaccccgacgaccccgtaaacggccccctaaaccccg

SEQ ID NO: 343442 - DNA, 552 bp, Homo sapiens
  misc_feature: GZ8MTXP01ETSOE.13.71.G05.1.454.CMB.2.raw
  modified_base (252)..(252): a, c, t, g, unknown or other
  misc_feature (252)..(252): n is a, c, g, or t
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (507)..(507): a, c, t, g, unknown or other
  misc_feature (507)..(507): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaactccctgacactgtcttgtgtagcctntggattcagcttcagaacctatggcatgcacgtcgggtccgccacggcccccaggcgaagggggctggagtggctgacttctttancatatgataggaagtacaaaattcatgcaagactccggtgaacgggccattccgacgtctccgaggacaactaccaaagtaacaccttatactctancaggatgaacngcctgagaggtcgacgtaccgtcggtctggtaacttacttcgtggttcgacgaacaaacgngttagtaagttggttaaggagtggggttattgttaacggttaacc

SEQ ID NO: 343443 - DNA, 592 bp, Homo sapiens
  misc_feature: GZ8MTXP01DMI83.13.71.G05.1.454.CMB.2.raw
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctcgtgggttcagcttcagtgtatattggatgagctgggtccgccagactccgaggggaggggctgggaggtgggtggccaaacataaaacacgagacggaagtgacccatactatgcggactcgtgtggaaagggccgaattcaccatctaccagacgacaacgccaagaactcactatattgacaaagtcgaccgctagagagacgaggacacggtctatgttatacgtgtgcgaggagtattacggaggtcggttaggccgttaacggtaagggggtttccgggggaaccccgggggtaaacccttggggttacccctaacccgggttaactaaaccccg

SEQ ID NO: 343444 - DNA, 738 bp, Homo sapiens
  misc_feature: GZ8MTXP01B3D61.13.71.G05.1.454.CMB.2.raw
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagccgtggggaatccctgacactgtcttgtgtagcctctggattcagcttcagaacctatggcatgcacgtcgggtcccgccgacggcccccaggcgaagggggcngggagtggctgtacttctttanctatatgataggaaagttaactaaaaagtttctaagtcgactaaacggtaccgtacccggtaagggaaaccggggtcccgtaacgttacccgtacccggttacccgtacccgaacggggtaaacccaaacccggttaaccccaaaacggtaaaacccttaaccctttaattaactaccgttacgaacccgtaagggtaacgtaacggtaaaccgacggtacccgtaagggaaacgggtaacgggttaaccggaaccgggtaaccgttaccggggtcctttaaggttaaccgtttaaaccgtttcggtcggttaacggaaccgtaaaacttaaaacgttgttacggttaagtttggtttaagggtagttagggttacgttggttaacgtttaacccg

SEQ ID NO: 343445 - DNA, 606 bp, Homo sapiens
  misc_feature: GZ8MTXP01C7PTN.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagacgcgaggccacgtccctgtgctggtcatctatcaagctaaccgaacgccgaccctgagggactcccccgtaggacgcgtacttcctaccgtcggtcctacccaaactccggtacgggaaaccacgacgaccctacctctacgacactacgacggaccgggaccgacggtcgtcggtggagtaggaggacggtacgtacgttaagttacgtgtcggacggtcgtacggggggggacagcgacgcgtaacgtccgttccgtaccgttacggtaaccggtacgggaaccgttacggttaccgtaacccgtaccgtaacggtccgaccgacccgaaccgaacccgtaaccccg

SEQ ID NO: 343446 - DNA, 550 bp, Homo sapiens
  misc_feature: GZ8MTXP01C0QW1.13.71.G05.1.454.CMB.2.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtgcagctggtggaatcgtgggggagcgtggtccagcctggggaatccctgacactgtcttgngtancctctggattcagcttcagaacctatggcatgcacgtcgggtccnccacggcccccaggaccgaagggggctggagtggctgacttctttancatatgataggaatactaaaatctatgacagtacttccgagaacgggcctattccgacgtctacgaggaccaaacacaaacgtaacacttanactcacgacaaggatacgaaactagccgtagaggacggtacgacgtacgtcggtctaggtaacttacttgtcgngaacgtacaaangttagtaagtgttggagtgattgttcgttaacc

SEQ ID NO: 343447 - DNA, 525 bp, Homo sapiens
  misc_feature: GZ8MTXP01DBPU1.13.71.G05.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggttttcctcgttagctcttttaagaggtgtccagtgtcaggtgcagctggtggaatcgtgggggagcgtggtccagccgtggggaatccctgacactgtcttgtgtagcctntggattcagcttcagaacctatggcatgcacgtcgggtccnccgacggcccccaggccgaagggggctgggagtggctgacttntttancatatgataggaatactaaaattctaatgacagactcgtagaacgggcatcacgtcncgagacaacacaagactactanatcagacaggactagaacagctagagaggtagacgtacgtggctgtaactacttntggngacaanaaattnttgtaagtgttggngtgttacttggttcgttaac

SEQ ID NO: 343448 - DNA, 705 bp, Homo sapiens
  misc_feature: GZ8MTXP01CEBL3.13.71.G05.1.454.CMB.2.raw
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtgcagctggtggaatcgtgggggagcgtggtccagccgtggggaactcccgtgacncttgtcttgtgtacgcctgtggattcgagtcttcagtaacctatggcatcgcacgtcgggtccnccgacggccccgaggcgaaggggctggagtggctggtaccttcttttaanctatagtacgtagtaggtaaacgtaaactaaaattctagtcgacgtaacgtaccgtacggtaacggaccgggtacctacgttacccgtacccgtaccgtaaccgaacggtaaacctaaacccgtaaaccgaaaacgtaaaccttaaccttaactactacgtacgtaacgtaagggtaacgtaacgaaaccgtacgtaccggtaaggaacggtacggtaccgtaaccggtaccgttaccggtacgttacggttaacttacgttcgtacggttacgtaaaccgtaaacttaaacggttgttacggttaaggttaggttaaggtaggttacggttagttaacgttaacgttaacccg

SEQ ID NO: 343449 - DNA, 580 bp, Homo sapiens
  misc_feature: GZ8MTXP01EAZL5.13.71.G05.1.454.CMB.2.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (537)..(537): a, c, t, g, unknown or other
  misc_feature (537)..(537): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtgcagctggtggaatcgtgggggagcgtggtccaggcctggggaactccctgacactgtcttgtgtagcctctggattcagtcttcagaacctatggcatgcacgtgggtcccnccacggccccgaggcgaaggggctggagtggctgacttntttanctatatgataggaagtactaaaattctatcgacagacctccgtaggaacgggcctaattccgaccgtctaccgaagggaaccaaactaccaaagtaacctaaccttaatactctagaccaaggactacgaaacagacctagagacggtacgaccgtacgtcggctgtaacttacttcgtgttacgacgtaacaagttnttagtaagttggttaagggagttaggattcggttgtttaaccc

SEQ ID NO: 343450 - DNA, 556 bp, Homo sapiens
  misc_feature: GZ8MTXP01DH006.13.71.G05.1.454.CMB.2.raw
  modified_base (292)..(292): a, c, t, g, unknown or other
  misc_feature (292)..(292): n is a, c, g, or t
  modified_base (339)..(339): a, c, t, g, unknown or other
  misc_feature (339)..(339): n is a, c, g, or t
  modified_base (421)..(421): a, c, t, g, unknown or other
  misc_feature (421)..(421): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaactccctgacactgtcttgtgtagcctctggattcagcttcagaacctatggcatgcacgtcgggtccnccgacggccccaggcgaagggggctgggagtggctgacttcttttancatatgataggaatacaaaattcatgcagtactcgtagaacgggcatcacgtctacgaggacaactacaagaacctacttanactctagacagatagaacacgctagagaggtacgacgtacgtcggtctgtaacttacttcgtagttcgaacgaacaaacgttgttacggtaagttgggtttaaggtaggtggttacttgttaacggtttaacccg

SEQ ID NO: 343451 - DNA, 625 bp, Homo sapiens
  misc_feature: GZ8MTXP01DWQ59.13.71.G05.1.454.CMB.2.raw
  modified_base (254)..(254): a, c, t, g, unknown or other
  misc_feature (254)..(254): n is a, c, g, or t
  modified_base (345)..(345): a, c, t, g, unknown or other
  misc_feature (345)..(345): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcgtgggggagcgtggtccagccgtggggaactccctgacactgtcttgtgtagcctntggattcagtcttcaagaacctatggcatgcacgtcgggtcccgccgacggcccccaggcgaagggggctggagtggctgtacttctttancatatgataggaataacaaaattctaatgacagtaccgtccggtaggaacgggcctatccaccgtcaccgaggaaccaaactaccaaacgaactaccttaatactctagacagatagaaaccacgaccgtagaggacggtacgaccggtacgtccggtacttacggttaacttacgtttcgtacggttacgaaacccgaaacttaaaaacgttgttaaggtaagtttagggttttaagggacgggttagggttaacgtttggttaacggtttaaaccccg

SEQ ID NO: 343452 - DNA, 544 bp, Homo sapiens
  misc_feature: GZ8MTXP01AFB4Y.13.71.G05.1.454.CMB.2.raw
  modified_base (355)..(355): a, c, t, g, unknown or other
  misc_feature (355)..(355): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaatccctgacactgtcttgtgtagcctctggattcagcttcagaaccctatggcatgcactgggtcccgccacggcccccaggcgaagggggctgggagtggctgacttctttatcatatgataggaagtanaaaatctatgcagactccgtgaaggctatcacgtctccgaggacactcaagaacaccttatctctagcaggtataggaacacgccgtagagtaggtacgacgtacgtcggtactgtaactacttcgtagttcgacgtaaccaagttagttgaagttggttaaggaggttggagttggttcgtttaaccg

SEQ ID NO: 343453 - DNA, 730 bp, Homo sapiens
  misc_feature: GZ8MTXP01A3J8J.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcactcacctgctcgtaggaagtaagttaaaggttagggggaattaaagtattgactttggcgttaggtactacgagacgaagacgccgacggccgaccgtcccctggtcgtcgttggtactacttactatacaaagtactaccgaacggccggaccccgtacggacgggtacctccccccgtaggacgtcgttacttccctacgtccggtcctacccgtaaccgtacgtacgggaaccacgaccgtacctactctacgaccacgtaccgacggggacccgggacccgaggtccgttgggtaggagtacggacggtcgttaacggtactttacgttaccgttcggtacggacggggttacggacgggaccgtggaccgcggtccctccgggttaccgttcccggtttaacccggttaaggggtaacccggtacccggggttaaaccgttaaccgggttcccgttaacccgggtaccgttaacgggaacccctaccggaaccccggaacgttaacccccgtaaaccccg

SEQ ID NO: 343454 - DNA, 670 bp, Homo sapiens
  misc_feature: GZ8MTXP01BO6RH.13.71.G05.1.454.CMB.2.raw
  modified_base (253)..(253): a, c, t, g, unknown or other
  misc_feature (253)..(253): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagtcttggttcagccgtgggggtccctgagactctcgtgtgcagcctntggtattttagtttagctagttatcgccatgagtcgtcgggtcccgccgacgggtcctccggaaggggaacggggtcgtggggtaggtttgggggttttacggtatttaggtcgtcttcgtttgatgtagtagcactatactagtcgacagtaacccgttaccgggttaacgggcccgtccttaccacctaactccaccgaagaacgaactaacttaccgaaacgaaccacgtactatactccgtagcgaagtacgagaacgacggccggtagggaaccggaccggaacggaccgtaccggttacgttaactcgtacgtggtacggaacgtaagttaattagttagtaaagtggttacgttggttacgtcgtagtaaccttacttaccgttacgttttaacgaacgttaacccgggg

SEQ ID NO: 343455 - DNA, 633 bp, Homo sapiens
  misc_feature: GZ8MTXP01DKQYL.13.71.G05.1.454.CMB.2.raw
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
  modified_base (522)..(522): a, c, t, g, unknown or other
  misc_feature (522)..(522): n is a, c, g, or t
  modified_base (546)..(546): a, c, t, g, unknown or other
  misc_feature (546)..(546): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtggggggaggcttggttcagccgtggggggtccctgagactctcgtgtgcagcctctggtattttagttttagctagttatgccatgagcgtgggtccnccgaggctccggaggggaagggctggggtaggttggggtttcgggtatttaggngtcttcgttgatgatagcacactactatgcagaaccgttccggtaagggccctcttaccacctntcctccgagacgaactaattaccaaagaacacgacttataatctgacagatagaaacgacgtcccgtagggaccgaccggacggaccgtacgggttaccgtttacncgtacgtgtcgaacgtaaaagttnttaaagtttaggtaaatggttaagttgggttacgtcgttacgtccttaacgtaccttttacgtttttcggaaccgtttaaccggggg

SEQ ID NO: 343456 - DNA, 528 bp, Homo sapiens
  misc_feature: GZ8MTXP01A46PF.13.71.G05.1.454.CMB.2.raw
  modified_base (432)..(432): a, c, t, g, unknown or other
  misc_feature (432)..(432): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagtgggggataaatatgcttgctggtatcagcagagccaggccagtcccctgtgctggtcatctatacaagactaccaacgccggaccctcaggggactccccccgtgagcgtattctcgtggtcctccaaactcgtacgggaacacacgcccactctagaccatccaggccgggtacccaggctggtgagtgaggctgtactattacgngtcgaggcgtgggacagcaggcaactcgcctccgttacggacgtcgggaccgaggttccaacccggtctcggtcacgcccaacgggccccaacccg

SEQ ID NO: 343457 - DNA, 611 bp, Homo sapiens
  misc_feature: GZ8MTXP01BOF4Z.13.71.G05.1.454.CMB.2.raw
  modified_base (348)..(348): a, c, t, g, unknown or other
  misc_feature (348)..(348): n is a, c, g, or t
  modified_base (465)..(465): a, c, t, g, unknown or other
  misc_feature (465)..(465): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagccgtggggaactccctgactactgtcttgtgtacgcctctggattcagtcttcagaacctatggcatcgcacgtcgggtcccgccgacggcccccgaggcgaagggggctggagtggcttgtacttctttanctatagtgagtaggaagtactaaaattctaatcgactaagtaccgtaccggtaggaacgggcctacttccaccgtcgtaccgaacggaacctaactaccaaacgtaactaaccttanactctagacaggactagaacacgactagagaggtacgacgtaccgtcggtcttgtaacttacgttcgtagttacgaacgtaaccaaagttgttaggtaagtttaggtttaagggaaggttggttaagttggttaacgtttaacccg

SEQ ID NO: 343458 - DNA, 725 bp, Homo sapiens
  misc_feature: GZ8MTXP01CTE2E.13.71.G05.1.454.CMB.2.raw
  modified_base (183)..(183): a, c, t, g, unknown or other
  misc_feature (183)..(183): n is a, c, g, or t
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtncagctggtgaatcgtgggggagcgtggtccagccgtggggaactccctgactactgtcttgtgtacncctcgtggtattcgagtccttacgaagaaccctagtggacctagtcgacctacggtcggggtccccgaccgaccggccccccgaaggccgaaaggggggtcctaggggacggtcggtcttacggtactttcttttaacncagttagtacggtaagttagggaaacttaaactaaaaaatttccctaatcggacaaggtacccgttaccgggtagggaaaccggggtcctaacttacccgtacccggtaccgtaacccgaacggggaaacctaaaccgttaaacccgaaacgtaaacctaacccttaataactcgtacgacctaaggggaacttaacgaacgacgccgtaaggaaggacggttacgaccgaaccgtcgggtaccttaggttaaacttcgtttccaggttacgaacgaaccttaaacgttgttaggtaagtggttggtaggtaggttaccgttgttcgtttaacccg

SEQ ID NO: 343459 - DNA, 591 bp, Homo sapiens
  misc_feature: GZ8MTXP01CR2WH.13.71.G05.1.454.CMB.2.raw
  modified_base (409)..(409): a, c, t, g, unknown or other
  misc_feature (409)..(409): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (533)..(533): a, c, t, g, unknown or other
  misc_feature (533)..(533): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctcgtgggttcagtcttcagtgtatattggatgagcgtgggtcccgcagactccgaggggaaggggctgggaggtgggtgaccaaacaataaaacacgaggaacggaagtcgaacccatactatcggcggactcgtgtggaaacgggcccgtattcaccntctccaagacgaaccaacgaccaaagaacctcaacttaatattagactaaagtcgggaacccncgtaggaagagaacgaggaacncggntagtgttactactggtgaagtaagagattggaagngttggcttaggaaggggttcgggggaaccggtaaccctgggacctaaccggctaaccg

SEQ ID NO: 343460 - DNA, 681 bp, Homo sapiens
  misc_feature: GZ8MTXP01CVG6C.13.71.G05.1.454.CMB.2.raw
  modified_base (607)..(607): a, c, t, g, unknown or other
  misc_feature (607)..(607): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcggtggggaggcgttggtcaggccggtgggggtcctgagactctcgtgtgcagccttgtggtattttagtttagctagttatcgccagtggacgtcgtcgggtcccgccgaggccgtaccggaaggggaaggggtcgtaggggtaggtttgggggtttacgggttattaggtcgtcgttcgttaggatagaagtacgacaactaactacttagcgacgacgtaaccgttaccggtaacgggtccctacctaccaccctactcctaccaaggactaaactaaaccgtaccaaagaacctacgtacttataacgtcgtaagaccaagtaacgtacgaacggacggtcgggtaagggaccgtccggaacgaccgtacggtttaccttagtccgacgtagagaaagtaaagttnttagttagaaagtggttagttcgggattccgtagttccttaacgttacgtttacgtttccgaacggttccgggg

SEQ ID NO: 343461 - DNA, 556 bp, Homo sapiens
  misc_feature: GZ8MTXP01CKOYJ.13.71.G05.1.454.CMB.2.raw
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (524)..(524): a, c, t, g, unknown or other
  misc_feature (524)..(524): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagccgtggggggtccctgagactctcgtgtgcagcctctggtatttagtttagctagttatgccatgagcgtgggtccnccaggctccgaggggagggctgggaggtggggttcgggtattagtgtctctttgagtgatagcactatactagtgcagtaactccgtaagggcctcttcaccanctcaganacaatcaagaacacgcttatatctgacagatagaaacnggaccgtgggaacgccgagacgcggtaccgtttancgtagtgagaagtaaattattagttagtaagtgttagttggttactntgtaacctactacttacgtttcgaacgtcggg

SEQ ID NO: 343462 - DNA, 626 bp, Homo sapiens
  misc_feature: GZ8MTXP01EYKEM.13.71.G05.1.454.CMB.2.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (511)..(511): a, c, t, g, unknown or other
  misc_feature (511)..(511): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttctgtggctattttaagaggtgtccagtgtgaggtgcaactgttggagtcgtgggggagcttggtcagccgtggggggtccctgagactctcctgtgcagcctcgtgggttccaccgtcagtccacacctanatgagctgggcccncaggcctaccgaggggagggctgggagtgcgtcttntttttattagtagtagtaggtatacattacctccgacacgactcggtaggacgggggccctaattccacctactcctaccgagacgacaaacttccaaagacacgtcttgtttacttacaaattacgaacagcctagaacgtacgcggatcggaacctacggaccgttgtaattcgtggtcggngagaggtaggtccggggacccttaacggtaacgttaccgtacggcttaacgggttggaccggttcggacgggggaacccgaaacgggcccgaaccgggtcccgaacccggttccc

SEQ ID NO: 343463 - DNA, 564 bp, Homo sapiens
  misc_feature: GZ8MTXP01CBDUK.13.71.G05.1.454.CMB.2.raw
  modified_base (184)..(184): a, c, t, g, unknown or other
  misc_feature (184)..(184): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (439)..(439): a, c, t, g, unknown or other
  misc_feature (439)..(439): n is a, c, g, or t
  modified_base (521)..(521): a, c, t, g, unknown or other
  misc_feature (521)..(521): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtncagctggtggaatcgtgggggagcgtggtccagccgtggggaactccctgacactgtcttgtgtagcctctggattcagcttcaagaaccctagtggcatcgcacgtcgggtccnccacggcccccgaggcgaagggggctggagtgctgacttntttancatntcgataggaagtacaaaattctagtgacacgtacctcggaggaacgggcctaatcaccgtctacgacggacaactaccaagaactacttanatctgcagtatagaacagcctggagtaggagacgtacgtaggtatagttaagttaccttgtagttcgaacaaccaaacgttnttagtaagttaggttggaggttcggttagttgttcgtttaacc

SEQ ID NO: 343464 - DNA, 602 bp, Homo sapiens
  misc_feature: GZ8MTXP01EVQEZ.13.71.G05.1.454.CMB.2.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (519)..(519): a, c, t, g, unknown or other
  misc_feature (519)..(519): n is a, c, g, or t
  modified_base (558)..(558): a, c, t, g, unknown or other
  misc_feature (558)..(558): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtgcagctggtggaatcgtgggggagcgtggtccagccgtggggaactccctgactactgtcttgtgtacgcctctggattcagtcttcaagaacctatggcatgcacgtcgggtcccnccgacggcccccgaggacgaagggggctaggaggtggctgtacttntttancatatgataggaagtactaaaattctatgacagactccggtaggaacgggctacttccgacgtccgtacgaacggaaccaaccgtaaccaaacgtaaacctaccttaatactactagacaaggagtaacgaacacgccgtaggaacggaggtacgacgtaacgtccggnttgtaacttaacttcgtgttacgacgtaaaccaaagttnttaggtaagttggttaaggagtggttacttgttaacgtttaacc

SEQ ID NO: 343465 - DNA, 592 bp, Homo sapiens
  misc_feature: GZ8MTXP01CMP39.13.71.G05.1.454.CMB.2.raw
  modified_base (296)..(296): a, c, t, g, unknown or other
  misc_feature (296)..(296): n is a, c, g, or t
  modified_base (481)..(481): a, c, t, g, unknown or other
  misc_feature (481)..(481): n is a, c, g, or t
  modified_base (545)..(545): a, c, t, g, unknown or other
  misc_feature (545)..(545): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcgtgggggagcgtggtccagccgtggggaatccctgacactgtcttgtgtagcctctggattcagcttcagaacctatggcatgcacgtcggggtcccnccgacggcccccaggcgaagggggctgggagtggctgacttctttagcatatcgataggaagtacaaaaagttctaatgactaaggaccttacggtagaaacggggcctattacccgaccgtctaccgaacgggaacctaactaccgaacgaacctaccttatactctagacaggtatacgaacngcctagagaggtacgaccgtcgtcggtcttggtaacttacttcgtgttcgacgaacaaacgttnttaggtaattggtttaagggaggttgggttattggttcgtttaaccg

SEQ ID NO: 343466 - DNA, 575 bp, Homo sapiens
  misc_feature: GZ8MTXP01A4SOS.13.71.G05.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (435)..(435): a, c, t, g, unknown or other
  misc_feature (435)..(435): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcaggccgtggggggtccctgagactctcgtgtgcagcctntggtatttagtttagcagttatgcatgagcgtgggtccncgaggctccgagggagggctgggagtggggtttcggtattagtgctcgttgatgatagcactatactatgacagaaccttccgggttaagggccctcttcacctatcaccagaagacaattacaaagaacacgactataactntcgacagatacgaacggacgccggtagggacggccgaaggaccgacgggtaccgtttanccgacgtgtagaacgtaaagnttaagttagtaaagtgagttggttagctagtctactacttattttcgaacgttaacgggg

SEQ ID NO: 343467 - DNA, 698 bp, Homo sapiens
  misc_feature: GZ8MTXP01D4DXM.13.71.G05.1.454.CMB.2.raw
  modified_base (470)..(470): a, c, t, g, unknown or other
  misc_feature (470)..(470): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcactcacctgctcgtggagagtaaagttagggggaataaatatgtcttgcgtggtatcgagacaaggaacgccgacggcccacgtcccctggtcgtcgtggtacatctaatacaagtactaaccgaacggcccggtccctacgacgggtacctcccccgtaggacgtcgtacttccgtaccgtcgggtcctaccgtaaaccgtccgtacgggaaaccaccgacgaccctactcgtacgaacccagtccgacgggacccggaacccgnggccgtgtaggataggacggtcgtagtacttagttacgtcgtacgcgggtcggtaacgggactcgggaccacggtccgtaaccgttccggaccccgtttacccgggttaaccgggaaaccgggttaccggggaacccgttaaccgggttaccccgtaacccgggttacccggttaacgggtacccgaacccgggacccccgaaaccgggttaacccccctaaaccccg

SEQ ID NO: 343468 - DNA, 639 bp, Homo sapiens
  misc_feature: GZ8MTXP01AUK89.13.71.G05.1.454.CMB.2.raw
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
tcagtcacgtactacacgaccggtgctcgatttagtgtcgtcgcaagagagagggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcgtgggggagcgtggtccagcctggggaactccctgacactgtcttgtgtacgcctctggattcagtcttcagaaccctatggacatcgacacgtgggtcccnccgacggccccaggcgaaggggctggagtggctgtacttctttancatatcgtataggtaaacgtactaaaaacgttcaagttgactaacggacctacccggtggaaacgggggcccttagttaccgacccgtcctacccggaacgggaaccaacgttaccaaacgtaaacctaccttaatacgtactacgtcaaggtagtacgaaacacgtccgtaggagtagggtacgacgtaccgtcggtacctggtaacttcgttcgtacgacgtaccgtaacaaacgttacgttagtaagtttggtttaaggaggttggttagtcggtttaacgtttaacccg

SEQ ID NO: 343469 - DNA, 732 bp, Homo sapiens
  misc_feature: GZ8MTXP01DJ2SX.13.71.G05.1.454.CMB.2.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcggtgggggaggcgtggtccaggccgtggggaactccctgacactgtcttgtgtacgcctctggattcagtcttcaagaacctgtggcatcgcacgtcggccnccgacggccccgaggcgacgggggctagggagtggcttaggtactttactttanctatagtgagttaaggaattaaactaaaatttctaatcgaccgtaacgtacccgtcggtaagggaacgggcctaacttacccgacgtacctaccggaacggaacctaaacctaaccgaaaacgtaacctaaccttaagtactacgtacgaaccgtaaggtaaacgtaacggtaaaccgtacgaccggttaagggaacgggttaaacggggtacccgtaaccggttaccgggttacgggttactttaacgggtttaactttaccggttacggtcggttaaccggtaaaccgtaaacgttaaaacgttggttaaaggtttaaggtttaggggtttcgggtagggttagggttacgtttcgggtttaaccttttaacccgg

SEQ ID NO: 343470 - DNA, 614 bp, Homo sapiens
  misc_feature: GZ8MTXP01CCO48.13.71.G05.1.454.CMB.2.raw
  modified_base (164)..(164): a, c, t, g, unknown or other
  misc_feature (164)..(164): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (497)..(497): a, c, t, g, unknown or other
  misc_feature (497)..(497): n is a, c, g, or t
  modified_base (574)..(574): a, c, t, g, unknown or other
  misc_feature (574)..(574): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagnggtgtccagtgtcaggtgcagctggtggaatcgtggggggagcgtggtccagccgtgggaactccctgacactgtcttgtgtagcctctggatcagcttcagaacctntggcagtgctacgtcgggcccncgacggccccaggcgaaggggctgggagtggctgactttctttanctattatagataggaataactaaaagttctaagtcgacgaacgtaccttcggtaggaacggggtcctagttcccgaaccgttcctacccgggaacggtaaccaaaccgttaccgaaacgtaacctaaccttatacgtactgacaggtatacggaaccncgcgtaggacgtaggtacgacgtcgtcgtcttgtaacttacgttgtcgccgaacgaacttaaacgttgttaagggtnttagggtttgggaggttcggattcggttaacgtttaaccc

SEQ ID NO: 343471 - DNA, 640 bp, Homo sapiens
  misc_feature: GZ8MTXP01C2MDQ.13.71.G05.1.454.CMB.2.raw
  modified_base (603)..(603): a, c, t, g, unknown or other
  misc_feature (603)..(603): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggcttattttaagaggtgtccagtgtgaggtgcaactgttggagtcgtggggggaggcttggttcaggccgtggggggtccctgagactctcgtgtgcagcctcgtggtattttagtttagctagttatgcatgagcgtgggtccgcaggcctcggaggggaggggctggggtaggttgggggtttcgggtattaggtgcttctttgagtgaatagcaactactaactatgacgaacgtaacccgttaccgggttaacggggccctcttaccgaccctatcctaccgaagaacgaactaaacttaaccgaaacgaaacaacgtactaatatactgacaagatacgaacggtacggccggtaggggacggaccggacggacgtaccggttaccgttacgtcctacgtgcggtaacgaaagttaattagttagtaagtgttagttggttacgtntagtcttacttacttacgttttaacgcgttaaccggg

SEQ ID NO: 343472 - DNA, 630 bp, Homo sapiens
  misc_feature: GZ8MTXP01D2UVQ.13.71.G05.1.454.CMB.2.raw
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
  modified_base (507)..(507): a, c, t, g, unknown or other
  misc_feature (507)..(507): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaactccctgactactgtcttgtgtagcctctggtattcagtccttacaagtaaccctagtcggcagtcggcctaacgtcgggggtccccncccgaacggccccccgagggccgaaacgggggcttagggagttgggcctttggtacctttcttttaancaattagtgtagtagggtaaataactaaaaatttcctaagtcgactaacggtacccgttccggtaaggaacgggtcctacttcccgaccgtctaccgaggaccaactaccaaagtaactaccttanactcagcagatagaacacgctgacgtagtacgacgtactggtctgttaattaccttgtagttcgaacgtaacaaagttgttagtaagttggttaaggacgtgacgttggttaacgttaacccg

SEQ ID NO: 343473 - DNA, 543 bp, Homo sapiens
  misc_feature: GZ8MTXP01DK9MJ.13.71.G05.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctntggattcagcttcagaacctatggcatgcactgggtccncaggccccaggcaaggggctggagtgctgactntttancatntgataggaagtcaaaaattcaatgcagactccgtagaaggggcctatcacgtctacgaggacaactacaagaacacctatatctagcaagggntagaacagccctagagacggtgacgtaacgttcggctggtaataacccttntagttcgacgaaccaaacagttagaatttggtttaacgggagttaggggaactgtttcggttaacccg

SEQ ID NO: 343474 - DNA, 652 bp, Homo sapiens
  misc_feature: GZ8MTXP01D5OHH.13.71.G05.1.454.CMB.2.raw
  modified_base (466)..(466): a, c, t, g, unknown or other
  misc_feature (466)..(466): n is a, c, g, or t
  modified_base (508)..(508): a, c, t, g, unknown or other
  misc_feature (508)..(508): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccagcatcacctgctctgagataaagttggggataaatatgcttgctggtatcagcagaagaccaggcccacgtcccctgtcgtctcggtcacttacttaagtacgaaacgtaactaacccgaacggcccggtaccccgttacgaacggggtaccttccccccgtggaacgtcgtactttccgtacgttcgggtcctaccgtaaccgtcgtacgggaaccacacgccctactcgtacaccagtcgacgacccggggacccaggtccnggtgagtagggacgcgttagacctttagtaccgtgtaccggnggtacggacgacgtcgacgacgtcgtaaccgtccggttacccttacgggttaaccggaaccggttaaccgggttaccggttaccggttacccgtaaccgttaccgtcgtacccggaccgaacccgtaacccgaacccgtaaccg

SEQ ID NO: 343475 - DNA, 717 bp, Homo sapiens
  misc_feature: GZ8MTXP01ANTV4.13.71.G05.1.454.CMB.2.raw
  modified_base (640)..(640): a, c, t, g, unknown or other
  misc_feature (640)..(640): n is a, c, g, or t
  modified_base (647)..(647): a, c, t, g, unknown or other
  misc_feature (647)..(647): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtggggaggcttggttcagccgtgggggtccctgagactctcgtgtgcacgtcctcgtagttattttagtttagactagttatcgcctagtgagtcggtcgggtcccgccgacggtcctaccgggaagggggaacggggtcgtaggggtacggtttcgggggtttacggttagtttaggtcgtcctttcgttagtagttggaatacgactaacgtacttaaccgtagtcgaaccgtacggtaaacccgttaccgggttaaccgggcccgtccttaccaccccgtatacccctacccaaagggaacctaaacctaaccgttaaccgaaaacgtaaccgtacgtaacttaaagttctaccgtagacgtaagtataacggaaacgcgggtcccgtaagggaccgaccggacgaccgtaccggttccttagtctacgtggtaacgaanaaagttntaagttagaaagtgttacgttggttactcgagttaaccttaactgtttacgtttgaacccgttaacgggg

SEQ ID NO: 343476 - DNA, 700 bp, Homo sapiens
  misc_feature: GZ8MTXP01BSSIK.13.71.G05.1.454.CMB.2.raw
  modified_base (403)..(403): a, c, t, g, unknown or other
  misc_feature (403)..(403): n is a, c, g, or t
  modified_base (609)..(609): a, c, t, g, unknown or other
  misc_feature (609)..(609): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactggttggagtcgtgggggaggtcttggttcacggccggtggggggtccctggagtacttcgtcgtgtgcagtccttcgtggttattttaggttttagctagttatcgccatgacgcgtcgggtcccgccgaggctccggaaggggaggggctaggggtcggtttgggggtttcgggtattaggtcgtcttcgttgatggatagcacacttactangacaggtaaccgttacccgggtaacgggcctaccttccacctattccgacctaaggacctaactaaacttacccgaaaagaaccaacgtactattactcgtagacgaagtactacggaaacggcggtaccggtagggggacgacccggtaaggacccgtaccgggttacctttagtacccgtagtcggtaccggaaagtaaagttnttaaagtttgtaaacgtggttaagttgggttacgcgttaccgtaacttaccgtacgttttaccgttttaacggaaccgtttaacccggggg

SEQ ID NO: 343477 - DNA, 638 bp, Homo sapiens
  misc_feature: GZ8MTXP01A9D3V.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggagagtaaagttgggggaataaatatgtcttgctaggtatcgagacaagaacgccgaggccacgtccccgtgtgcttgcatctaactacgaagtaactaaccgaacggccggacccctcgacggggactcccccgtagacgcgtacttcctaccgtcggtcctaccaacgtcgtacgggacacgacgccctactctacgaccagtccgaggacccgggacccagcgtaggaggaactggacgtcgtacgtaacgttacttacggtgtacgacggggtcggtacggggacctggaccgaacggtccaaccggttccgttaccccgttcccggttaaccgggaacgttaccggggaacccttacggggttcccctaaccggtaccgtaaggtacccacgaccccgaacggaacccctaaccccg

SEQ ID NO: 343478 - DNA, 717 bp, Homo sapiens
  misc_feature: GZ8MTXP01CYJAJ.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcacgccaccctcagtcgtccgtcgtcccaggacagacacgccagcactcacctgctcgtaggagaagttaaaggttagggggaataaatatagtcttgcgtaggtactacgagacgaagaacgaccgacggccgtaccgtccctgtcgcgtcggtactactctaatacgaaacgtacgtaaccgaacggccgtaccctacggacggtactccccccgtagacgtcgtacttccgtactcgcctaccaacgttacggacggaacacgacgcctaccttcgacgaccacgtaccggacgggacccggacccgagggtccgttagggacgtacgttagggacgtacgttaacgttaaccgtttagttacggtcggttacggacgggtcggtaacgggacgtaacgcgaacgccgtaacccgttcgggaccccgtttaccgggttaaaccgggtaaaccggtcggggttaaaacccgttacgggttacccgtaaaccccgggttaccgtaacgggaccccgaacggaaaccccggtaaccccgggaaccccctaaaccccg

SEQ ID NO: 343479 - DNA, 683 bp, Homo sapiens
  misc_feature: GZ8MTXP01DRA6P.13.71.G05.1.454.CMB.2.raw
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (520)..(520): a, c, t, g, unknown or other
  misc_feature (520)..(520): n is a, c, g, or t
  modified_base (542)..(542): a, c, t, g, unknown or other
  misc_feature (542)..(542): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaagtcggtggggggagcgtggtccaggccgtaggggaactcccgtagactacgttgttcttgtgtacgcctcgtggtattcagtcttacaagaacctatcggcagtcgcgtacgtcgggtccccncgacggccccaggcgaagggggctgggacggtggcttacggtacttagttttacnctaattagtagaagttagggtaaacttaaactaaaaaagtttcctaagtcgacgtaaacgtaccgttacccggtagggaaccgggtccgtaacttcccgaccgtacctaccggaaggtaaccaaactaccaaagtaccaccttaanactctagacagggatacgaacncgacgtgacggacggagaccgtacgtacggtcttacggttaactttcccttaggtcgttacgaaacggaaaaccttaaattggtttagtaagtttagggtttaaggtaggtaggttagtttaacggttaactttaaccccg

SEQ ID NO: 343480 - DNA, 658 bp, Homo sapiens
  misc_feature: GZ8MTXP01BU5ID.13.71.G05.1.454.CMB.2.raw
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (524)..(524): a, c, t, g, unknown or other
  misc_feature (524)..(524): n is a, c, g, or t
  modified_base (546)..(546): a, c, t, g, unknown or other
  misc_feature (546)..(546): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggcttggttcagccgtgggggtccctgagactctcgtgtgcagcctcgtggtattttagtttagctagttatgcatgagcgtcgggtccgcagggcctcggaggggagggcgtgggtaggttggggtttcggtattaggtgcttcgttgatgtangacaactatactatgactagaccttaccggttaagggccctctaccacattcacacganactaactacaagtaacacgtactatatctagactagaactacgaaacgtcgaccggttacggggacggaacccggacgggacccgtaccgggttaccttttaacnccgtaacgtgaaccgggtaaanaaaagtttagttaaagttagttaacgttaagggttagtttcggggttattaacccggttgtaaccgttaacgtttacttaccggttttttaacgaacccgtttaaccggggg

SEQ ID NO: 343481 - DNA, 615 bp, Homo sapiens
  misc_feature: GZ8MTXP01AJAFD.13.71.G05.1.454.CMB.2.raw
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (470)..(470): a, c, t, g, unknown or other
  misc_feature (470)..(470): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggtttcctcgttgctcttttaagaggtgtccagtgtcaggtgcagctggtggaatcgtgggggagcgtggtccagccgtggggaactccctgacactgtcttgtgtagcctctggattcagtcttcagaacctatggcatgcacgttcggggcccnccgacggccccagggaccgaagggggctggacgtggcctgtacttcttttancattanccggtatagggtaaactaacctaaaaattcctaagtggacagtaccttccggtaggaagggccgtactcaaccgtcaccgaagggacctaaccgacaaacacctaaccttataactntagttagatagaacacgcctagaggagtggacgacgtccggactggtaacttcgtcgttgtacgcggtaaaccaaagttacgttgaaacggtttggtttagggaagggttagggtattaccgggttcgtttaaccgtttaacccg

SEQ ID NO: 343482 - DNA, 695 bp, Homo sapiens
  misc_feature: GZ8MTXP01DAO14.13.71.G05.1.454.CMB.2.raw
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttgggagtcgtgggggagcgttggttcagccgtggggggtccctgacgactctcgtgtgcagtcctcgtggtattttagtttagctagttatgcctatggacgcgtcgggtcccgccgagggtcctaccgggaagggggaacggggtcgtaggggtaggtttgggggtttacgggttaatttaggtcgtcgtttcgtttaggagtgtaatacgacactaactactagtcgactaacggtaacccgttaccgggttaacggggccctaccttaccaacctactacgtaccgaagacgtaactaacttaccaaagaaccaaccgtataactacgtctagaccaagtaacgtacgaaaccggacggtacccggtaagggggacgaacccggacggtacccgacgggttacccgtttactacgtacgtgtaagaaacgtaaagttattagttagttaatggttacgttggttactctagtcttactactttacgttaacgcgtaacggg

SEQ ID NO: 343483 - DNA, 760 bp, Homo sapiens
  misc_feature: GZ8MTXP01C91P4.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcacgccaccctcagtcgtccgtcgtcccccgaggacagacagccagcatcacctgctctggagaataaagttggggaataaatatgcttgcgtggtatcagacagaacgccgaggcctacgtccctgtcgcgtcgcagtactaatacaaacgtactaaccgaacggccgtaccctacggacgggtacctccccccgtagacgtccgtacttcgtaccgttcggtaaccctaccctaacgttaccgacgggaaacaccacgaccctacgtctaccgaacctgtaccggacgggacccgggtaaccccggtagtccggttagggaaggtacgttacggggaacgtacggttaacggtttaaccgttaaacgttacggtttaccggtacccggggaaaggggtccgggttaaacgggggacttaacggacccgaacgaccgttaaccggtcccggttcccgttttaaccccggggttaaagggtaaacccgtccgggggttaaacccgttaaacgggttccccgtaacccgggtaacccgtttaacgggaacccccggaaccggttaaccccggaaccggttaaacccccccgtaaaccccgg

SEQ ID NO: 343484 - DNA, 697 bp, Homo sapiens
  misc_feature: GZ8MTXP01AXU5Z.13.71.G05.1.454.CMB.2.raw
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggagtcttggttcagccgtgggggtccctgagactctcgtgtgcagcctgtggtatttagtttagctagttatgcctagtgagtcgtcgggtcccgcgaggcctaccggaagggggaacggggtcgtaggggtagggtttcgggggtttacggggttaagttaggtgtcctttcgtttaggtagtgtaatacgactaacgtaattactagtcgaccgtacggtaaaccgttcccgggtaagggccccgtacttaccaccctatccgtaccaaagtacgaactaaacttaacccgaaacgaaaccacgtaacttaacttactacgtacgactaagaagtacgaaaccggacggtaccggtacgggacgtaccggaacggacgtaccggttacttacgtactaccgtgtaagtaacgaaagttagttaagttagtaagtagttagttggttacgtctacgtaacttacgtactttacgtttcgaacgttaaccggg

SEQ ID NO: 343485 - DNA, 530 bp, Homo sapiens
  misc_feature: GZ8MTXP01BF4Y6.13.71.G05.1.454.CMB.2.raw
  modified_base (171)..(171): a, c, t, g, unknown or other
  misc_feature (171)..(171): n is a, c, g, or t
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
  modified_base (462)..(462): a, c, t, g, unknown or other
  misc_feature (462)..(462): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctcagaaataatggacagataaatatacttcctaggtatcagcagaagtcagccagtcccctgtgctggtcagtctatcaaagntagaccgaagccggccctnagggactccccctgacgcgtattcgtactggctaccaaactcgtacgggactcagcccactctcgacatcaggccgggaccaggctagtggactgaaggctaggacttattacgtgtcgaggcgtagggactaggcagcaacgtcgccncttagtcgtcgttacggacgttcgggaacctaagggtccaaccgtcgttaaacgtccgaagaaccccg

SEQ ID NO: 343486 - DNA, 634 bp, Homo sapiens
  misc_feature: GZ8MTXP01CM504.13.71.G05.1.454.CMB.2.raw
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (605)..(605): a, c, t, g, unknown or other
  misc_feature (605)..(605): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaactccctgacactgtcttgtgtacgcctcgtggattcagtcttacagtaaccctagtggcatgacctacgtcgggtcccgccgacggccccgaggcgaaggggctggagtggcttgacctttntttanctatatcgagtaggaagtaactaaaattctatcgactagacgttccggaggaacgggtccctacttccgaccgtcctaccgaacgggtacctaaacccgtaccaaacgtaacctaccttaagtactacgtgaccaggagtacgaacacgtaccgtagaggtacggtacgaccgtccgtacggtcttaggtaacttacgttcgttacggttacgaacgtaaccaaagttgttacggtaagttggtttaaggggngttaggttacgttgttaacgttttaaccg

SEQ ID NO: 343487 - DNA, 531 bp, Homo sapiens
  misc_feature: GZ8MTXP01AFFH5.13.71.G05.1.454.CMB.2.raw
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaaccatggcatgcacgtgggtcccgccaggcccccaggcaagggggtctcggagtgggctggacttcttttatctatatcgagtggaaagtactaaaaattctaatgcaggactcccggtgggaaggccgattcaccgtctccagggacactaccaagaacacctatatctgcagatgaacaggcctgaggaggtagcgtaacgtcggcgtntaacgtacttngttgacaanaacgnttgaatggttgagtggctggttcttaacg

SEQ ID NO: 343488 - DNA, 696 bp, Homo sapiens
  misc_feature: GZ8MTXP01CNRQM.13.71.G05.1.454.CMB.2.raw
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
tcagtcacgtactacacgaccggtgctcgatttagtgtcgtcgcaagagagaggaggccagcactaggagtcggcggtgtttcctattcggtgatcagcagtgaacacagaggactcaccatggagtttgggctgagcttgggttttcctcgttgtcttcttttaagaggtgtccagtgtcaggtgcagcgtggtaggaagtcgtggggggagcgtggtccagccgtggggaatccctgacacttgtcttgtgtacgccttctggtattcagtcttcaagtaaacctntggcctagtcgccgtacgtcggggtccccaccgacggggcccccagggacgaacgggggtctggggtagtcggccttaggtaccttttcgtttttaanactaagttagtacggtaagttaacggtaaattaaactaaaagttctagtcgaccgtaacgtccggtacgggtagggaacgggtcctacttcccgtaccgtacgtaaccgaacgaaacctaactaaccgtaaactaacctaccttaatacgttacgtacgaacgtaaggtacgtaacgtaaccgacggtacgtaggaacggtcgtaccgacgtaccgtcgtacttagtaacttcgttcggtacgttacgaaacgtaacttaagttggttagtggttggttaaggtggtagttcgttcgttaacgttaaccg

SEQ ID NO: 343489 - DNA, 682 bp, Homo sapiens
  misc_feature: GZ8MTXP01BL99G.13.71.G05.1.454.CMB.2.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggcttattttaagaggtgtccagtgtgaggtgcaactgttggagtcgtgggggaggtcttggttcaggtccgtggggggtccctgagactctcgtgtgcagtcctgtggtatttagtttagctagttangcctatgagcgtcgggtccncgaggcctccggaggggaagggcgtaggggtaggtttgggggtttcggtaagttaggtcgtacttcgtttaggagtgaagtacgactactaacttactagtcgaccgtaacggtaacccgttacccgggttaacggggccctaccttaccaaccctactcctaccgaaaggtacaaacctaaacttaccaaacgaaccacgtactaatactctagacaagtacgtacgaacggcggcggtacgggacgaccggaaggacccgacggttaccgttactccgtacgtggtagaacgaaattgttagttaggtaaatggttaagttcggttactaacgtcgtaaccttaacttacgttacgttttcgaacgtttaacccggggg

SEQ ID NO: 343490 - DNA, 630 bp, Homo sapiens
  misc_feature: GZ8MTXP01D0EVP.13.71.G05.1.454.CMB.2.raw
  modified_base (295)..(295): a, c, t, g, unknown or other
  misc_feature (295)..(295): n is a, c, g, or t
  modified_base (568)..(568): a, c, t, g, unknown or other
  misc_feature (568)..(568): n is a, c, g, or t
tcagtcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtggggggaggcttggtccagccgtggggggtccctgagactctcctgtcaagcctctgggttcagtcttcagtgtatattggatgagcgtgggtccncagacgtccgaaggggaggggctgggaggtgggtggaccaacgaataaaacacgagaccggaagtcgaaccccaatactagtgcggactctggtggaagggccgtattccacctatcctaccagacgaacaacgtaccaaagaacctacaacttaattatttacgaacctaaaagttcggaaccccgcggtaggaagaacgacggagaccgtaggctaatggtaattacgtgtgaagtagagtattaggaaggtcggttcggattaaccgggngggggtttaccgggggaacccgggtaaccccgtggggttaccctaaccggttcctaaacccg

SEQ ID NO: 343491 - DNA, 682 bp, Homo sapiens
  misc_feature: GZ8MTXP01BRPBA.13.71.G05.1.454.CMB.2.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggtttccgcgttaggctctttaagaggtgtccagtgtcaggtncagctggtggaatcgtgggggagcgtggccagccgtgggaatccctgacactgtcttgtgtagcctntggattcagtcttcaagtaaccctagtcggctagtcgcctacgtcggggcccnccgaacggcccccgaggtcgaacgggggctgggaggttcggcttaggtacctttcttttaanactagtagtacgtagtaaggtaaacgtaaactaaaattctaagtcgtactaacgtaccgtacggtaggtaacggtcctacgttacccgtaccgtccgtaaccggaacggtaacctaacccgtaaccgaaacgtaaccttaacttactacgtacgtacgacgtaaggtaacgtaacgaacgacgtacgtaggacggtacggtacgaaccggtcgtacgtacgttgttaacgttacgttcgtcgttacgtaacgtaacgttaacgttacgttagtaagttaggttaaggtaggtaggttacgttaacgttaacgttaacg

SEQ ID NO: 343492 - DNA, 540 bp, Homo sapiens
  misc_feature: GZ8MTXP02I3T6Z.13.71.G05.1.454.CMB.2.raw
  modified_base (340)..(340): a, c, t, g, unknown or other
  misc_feature (340)..(340): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctctggattcagcttcagaacctatggcatgcacgtcggggtcccgccgacggcccccaggcgaaggggctgggagtggctgacttctttancatatgatggaatactaaaattcaatgacagactcgtagaacggcctatcacgtctaccgaggacaactacaacgaacaccttanactctagctanatagaacagacctagaggaggtcgacgacgtcggctagtactacttcgtgtcgacgaacaaactatagtaagttggttaggagtggtactggtacgtttaaccg

SEQ ID NO: 343493 - DNA, 516 bp, Homo sapiens
  misc_feature: GZ8MTXP02F3FRN.13.71.G05.1.454.CMB.2.raw
  modified_base (334)..(334): a, c, t, g, unknown or other
  misc_feature (334)..(334): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaacctatggcatgcacgtgggtccgccgaggcccccaggcgaaggggctggagtggctgacttctttancatatgatggaatacaaaaattctaatgcagactccgtgaagggccgattcaccgtctccgaggacaactaccaagaacaccttatatctgacagatagaacagacctgagagtagacgacgtcggctagtactacttntgtgacgaacaaacntagaagttgttagagtgatcgtagttac

SEQ ID NO: 343494 - DNA, 505 bp, Homo sapiens
  misc_feature: GZ8MTXP02FYYGG.13.71.G05.1.454.CMB.2.raw
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagataccaagcggcctcagggactccccctgagcgattctctggctccaactctgggaacacacgccactctcgaccatcagcgggacccaggctgnggatggaggctgactatactgtcaggcgtgggacnggacagcactcgcctccgttacggaactcgggaaccacgggtcaaccggtccaaggtcacgacccaacggacccaaacccccg

SEQ ID NO: 343495 - DNA, 535 bp, Homo sapiens
  misc_feature: GZ8MTXP02HCJGS.13.71.G05.1.454.CMB.2.raw
  modified_base (250)..(250): a, c, t, g, unknown or other
  misc_feature (250)..(250): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctntggattcagcttcagaacctatggcatgcactgggtcccgccacggccccaggcgaaggggctggagtggctgacttctttatcatatgatagaagtacaaaaattctaatgcatactccgtgaagggccgattcaccgtctaccagggacaactaccaaagaaacctaaccttaatatctagacagatagaacagactagagaggagacgacgtacgcgtagtatacttctcgtgacgaacaaacaatagtaagtgttaggtaggtaggtagtagttagttacg

SEQ ID NO: 343496 - DNA, 531 bp, Homo sapiens
  misc_feature: GZ8MTXP02I2SMB.13.71.G05.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctntggattcagcttcagaacctatggcatgcactgggtcccnccaggcccccaggccaaggggctggagtggctgactctttancatngatggaatcaaaattcatgcagactccgngaagggccattcacgtctccaggacactaccaanaacactanatctgcagatgaactagcctagagaggtgaacgacgtcggtctaggtaactactttctacgttagacgaaccaaaactgtagtaagttggtttagggaacgtggtattcggttagtttaacccg

SEQ ID NO: 343497 - DNA, 535 bp, Homo sapiens
  misc_feature: GZ8MTXP02F7JEQ.13.71.G05.1.454.CMB.2.raw
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
  modified_base (460)..(460): a, c, t, g, unknown or other
  misc_feature (460)..(460): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtctgggggaggcttggttcagcctgggggtccctgagactctcgtgtgcagcctctggatttagtttagcagttatgccatgagctgggtccnccaggctccagggaagggctgggagtgggtttcgggattagtgctcttgatgatagcacatactatgcagactcgttagggccncttcaccatctccagagacaattccaaagaacacgactatatctgacagatgaaacagcctagggagccgaagacgacggcccgtttaancagtgagacgaaagtattagtagtaagtgtagtcggtagcgtacgtacttactactttacgtttacgacgtacgg

SEQ ID NO: 343498 - DNA, 660 bp, Homo sapiens
  misc_feature: GZ8MTXP02GTOZ1.13.71.G05.1.454.CMB.2.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggagtctggaggaggcttgatccagccgtgggggtccctgagactctcctgtncagcctgtgggttcaccgtnagtcacacctacatgagcgtgggtccccnccgaggcctcccgaggggaggggctgggagtcgcgttcttnttttattatagtagtggtatacatactccgcaagtccgtccggtagggacgggggtccctaattcccaactactccctaccgaaggaacgaactaaacttacccgaaagaaacccnccggttcttcgtttacccttaaaanaaacgtacgaacgacgtcgtaagacgacgaccgtagtacgaccgtaccggtcgttagttaacgttcgtgggtacgacggaagggacggtacgggtacccggggaacccgtaacggttaaccgttacgtaaccggtacgttaacggtcgggaccggttccggggtaccgggggaaccgtaaccgggg

SEQ ID NO: 343499 - DNA, 560 bp, Homo sapiens
  misc_feature: GZ8MTXP02IHUGF.13.71.G05.1.454.CMB.2.raw
  modified_base (164)..(164): a, c, t, g, unknown or other
  misc_feature (164)..(164): n is a, c, g, or t
  modified_base (251)..(251): a, c, t, g, unknown or other
  misc_feature (251)..(251): n is a, c, g, or t
  modified_base (344)..(344): a, c, t, g, unknown or other
  misc_feature (344)..(344): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
  modified_base (521)..(521): a, c, t, g, unknown or other
  misc_feature (521)..(521): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagnggtgtccagtgtcaggtgcagctggtggaatcgtgggggagcgtggtccagccgtggggaatccctgacactgtcttgtgtagcctntggattcagcttcagaacctatggcatgcacgtcggggtccccgccgacggcccccaggccgaaagggggctgggagtggctgacttctttancatatgatggaatacaaaattcatgcagactccgtaggacgggcctatccaccgtctaccgagggaccaactaccaaacgaacctaccttaatactctagtacagactagaaacngacctgacgaggtgacgacgtcggtctagtaacttacgttcngtacgacgtaacaaaacgtntagtaagttggttaggagtaggtattgtacgtttaaccg

SEQ ID NO: 343500 - DNA, 556 bp, Homo sapiens
  misc_feature: GZ8MTXP02JGUFX.13.71.G05.1.454.CMB.2.raw
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
  modified_base (479)..(479): a, c, t, g, unknown or other
  misc_feature (479)..(479): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtcgtgggggaggcttggttcagccgtgggggtccctgagactctcgtgtgcagcctctggatttagtttagctagttatgccatgagctgggtccgccaggctccgaggggaaggggctgggaggttggggtttcgggtattaggtgctnttgatgatagcacatactatgcagactccgttagggcctcttcaccatcncagacgacaataccaagaacacgactatactctgacaagatagaacaggccgtaggggacgccggaaggacgacggtaccgtttancactgtacgacgaaagtataatagtaactgaagtggtagccgtagtactacttactactttttacgacgtttaccgg

SEQ ID NO: 343501 - DNA, 575 bp, Homo sapiens
  misc_feature: GZ8MTXP02IG9BW.13.71.G05.1.454.CMB.2.raw
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtctgggggaggcttggttcagcctggggggtccctgagactctcgtgtgcagcctctggtatttagttttagcagttatgccatgagctgggtccgccaggctccgagggaaggggctggagtgggttcgggtatagtgctctgatgatagcacatactatgcagacctccgttaggggcccncttcaccatctccanagacaattccaaagaacacgactatactctgcagatgaacgagcccgtgggacgccggaacggaccgacgggtacccggtttaatccgtaaccgtgtcgacggtaaaaggataacgtttagtaaattagaagttaggtaagtcgtaggtacctactacttactttttacgaacctttaacgggg

SEQ ID NO: 343502 - DNA, 500 bp, Homo sapiens
  misc_feature: GZ8MTXP02G82Z3.13.71.G05.1.454.CMB.2.raw
  modified_base (349)..(349): a, c, t, g, unknown or other
  misc_feature (349)..(349): n is a, c, g, or t
  modified_base (436)..(436): a, c, t, g, unknown or other
  misc_feature (436)..(436): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaaggcaggccagccccctgtcctactcatctttcaaaatccaggcgccctctggggtcccctgagcgatccctccggctccgcctctggaacncagtcactctgaccatcagtggacccagcctatgatgagctgtctacttctgtcagggtcgtgggacaacgagcgtgctggttcggnggagggccagtctgaccgtctacggtcacgcccaaggctcgcccctggtccactctcgttcccc

SEQ ID NO: 343503 - DNA, 542 bp, Homo sapiens
  misc_feature: GZ8MTXP02H7BOW.13.71.G05.1.454.CMB.2.raw
  modified_base (352)..(352): a, c, t, g, unknown or other
  misc_feature (352)..(352): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaaggcaggccagccccctgtcctactcatcttacaaaatccaggcgcctctggggtccctgacgcgattcccgccggcctccgcctcgtgggaacncacgtcactctgaccatcagtcggaccagcctatgatgagctgtctacttctgtcagggtcgtacgggacaacgagcgtgtcgtggttcggcggacgggacccaggtcgtcggaccgttcgttaacggtcacggtcccgaaggtccgtccggcccccgttcggtcctacccgttcttacccgtttccccc

SEQ ID NO: 343504 - DNA, 582 bp, Homo sapiens
  misc_feature: GZ8MTXP02HIN4D.13.71.G05.1.454.CMB.2.raw
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtgggttttcctcgttaggctcttttaagaggtgtccagtgtcaggtgcagctggtggaatcgtgggggagcgtggtccagcctggggaatccctgacactgtcttgtgtagcctctggattcagcttcagaacctatggcatgcacgtgggtcccnccacggccccaggcgaaggggctggagtggctgacttcttttanctatatgagtaggaatacaaaaattcatgcagactccgtgaacgggcctatcaccgtctaccgagggacaactacaacgaactaccttatactctanacgaagatagaacacgtaccagaggaggtacgacgacgtccgggtatacggtttaataccgttcgtagttcgaccggtaaaccaaaaactgttaggtaagtttgggtttagggtaaggtggggttaacttgggtaccgttttaaccg

SEQ ID NO: 343505 - DNA, 525 bp, Homo sapiens
  misc_feature: GZ8MTXP02I8T79.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtccccctgtcgctggtcatctatcaagataccaagcggcctcagggactcccccgtgagcgtattctcgtcggctccaactcgtacgggaaccacgacgcccaactctacgaccatcgagccggacccaggcctggtggatgacggctagactattacgtgtacgaggcgtggacagcagcacgtgcctcgtacgaacgtcggaaccaggtaccaaccgtccgtacggtccaacgccccgaacggaccccaaaccccg

SEQ ID NO: 343506 - DNA, 725 bp, Homo sapiens
  misc_feature: GZ8MTXP02JJWZV.13.71.G05.1.454.CMB.2.raw
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccaggccgtggggaatccctgacactgtcttgtgtagcctcgtggattcagcttcagaacctagtggcagtcgccacgtcggtccccgccgaccggccccgagggaccgaaacggggccgtagggacggtcgggccgttaggtacctttctttttaatcctaagttatacgtaagtaggtaaactaactaaaaatttctaatcggactaacggtaccgttaccggtaggtaacgggccgtacgttacccgaccgttaccgtacccgaacggtaaccctaaacccgttaccgaaacgtaaaccttaaccctttaattacgttaccgtacggaccgtaagtaacgttacgaaaccgtacggtacccgttaggaacggtacgggttacggaacccggtaccgtaccgggtaccgttacggtttaacgttaccgttacgtacggtacgtaacccgaacctaaaaccgtagtacgtaagttacggttacggacggtaggtacgttcggtacgtttaccg

SEQ ID NO: 343507 - DNA, 656 bp, Homo sapiens
  misc_feature: GZ8MTXP02HQ5JB.13.71.G05.1.454.CMB.2.raw
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (504)..(504): a, c, t, g, unknown or other
  misc_feature (504)..(504): n is a, c, g, or t
  modified_base (561)..(561): a, c, t, g, unknown or other
  misc_feature (561)..(561): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttctgtggctattttaagaggtgtccagtgtgaggtgcaactgttggagtctgggggaggcttggttcagcctgggggtccctgagactctcgtgttcgcncgtcctgtagttagttttagttagctagttancgcagtagcgtcggtcggtcccgcgacggtcctaccgggaagggggacgggtcggtaggggtagggtttcggggtttacgggttaagtttggtcggtcctttgttagtagtagagtacgactaactaacttactagtcgacgtaagtaccgttacgggtaccggggcccttctaccacctctcctacgaagacaactaacctacgaaaacaccaccgtatatactcgngacagatacgaaagccgtgggaggaccgaccggaacgacggacccgggtttctaacnccagttgacgaacggtaaattattagttaagacttgaacggttgacgtcgtacgtacctttaactacgttttacggtttacaacgtttaccgggg

SEQ ID NO: 343508 - DNA, 556 bp, Homo sapiens
  misc_feature: GZ8MTXP02HER4Q.13.71.G05.1.454.CMB.2.raw
  modified_base (251)..(251): a, c, t, g, unknown or other
  misc_feature (251)..(251): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctntggattcagcttcagaacctatggcatgccacgtgggtcccgccgacggcccccaggcgaaggggctggagtggctgacttctttancatangatggaagtacaaaattcatgacagaccgtccgtagaacgggcctatccaccgtctaccgagggaccaactaccaaagaacctacttaatactctagcaagatagaacgacgacctagagaggtagacgacgtcgtacgtagttacttacttgtcgtacgacgaacaaacagtagtaagttggttaggtagttagtacgttgttacgttaccg

SEQ ID NO: 343509 - DNA, 492 bp, Homo sapiens
  misc_feature: GZ8MTXP02FIU9S.13.71.G05.1.454.CMB.2.raw
  modified_base (408)..(408): a, c, t, g, unknown or other
  misc_feature (408)..(408): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggggataaatatgcttgctggtatcagcagaagccaggccagtcccctgtgctggtcatctatcaagataccaagcgcctcagggatccccctgagcgattctctggctccaaactcgtagggaacacagccactctcgacatcgagccgggacccaggctgtgatggagctagactattacngtcgaggcgtgggacagcagcactcgcctcgttcggaactcggaccaaggtcaaccgtctaggcacggccaacggcccaaaccc

SEQ ID NO: 343510 - DNA, 615 bp, Homo sapiens
  misc_feature: GZ8MTXP02GPSA7.13.71.G05.1.454.CMB.2.raw
  modified_base (247)..(247): a, c, t, g, unknown or other
  misc_feature (247)..(247): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggtttcgtcgtagctctttaagaggtgtcagtgtcaggtgcagctggtggaatcgtgggggagcgtggtccagcctggggaatccctgacactgtcttgtgtagcctntggattcagcttcagacctatggnangcacgtcggccgccgacgccgacggacgacggcgtggngtcggcgtgtacttctttatactatatagtagtagtaagtaactaaacttactatcgtacgacgtacgtacgtacggaacggtacgtacgtaccgtaccgtaccgtaccgaacggaaccgaacctaaccgaaacgtaaacctaaccttaactactactacgacgtaagagtacgaacgacgtacgtacgaggacggtacggtacgtacgtacgtacgttacgtacgttacgttacgtcgtacgtacgaacgtaaacgtagtagtaagttggttaggtacggtaggtacgttacgttacgttacg

SEQ ID NO: 343511 - DNA, 552 bp, Homo sapiens
  misc_feature: GZ8MTXP02GXNNM.13.71.G05.1.454.CMB.2.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (409)..(409): a, c, t, g, unknown or other
  misc_feature (409)..(409): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaacctatggcatgcacgtgggcccgccacggccccaggcaaggggcnggagtggctgacttctttancatatgatggaatacaaaattcaatgcagactcgtgaacggcatcacgtctcgaggacactacaacgaacaccttanactctagcaagatacgaacacgacctaggacggaggtacgaacgtacgtcggtactaggttacttacgttcgtagtacgaccgtaacaaactagtagtaagttgggtttagggaggttaggtagttaggttacggtttaaccg

SEQ ID NO: 343512 - DNA, 568 bp, Homo sapiens
  misc_feature: GZ8MTXP02JB0WH.13.71.G05.1.454.CMB.2.raw
  modified_base (288)..(288): a, c, t, g, unknown or other
  misc_feature (288)..(288): n is a, c, g, or t
  modified_base (375)..(375): a, c, t, g, unknown or other
  misc_feature (375)..(375): n is a, c, g, or t
  modified_base (470)..(470): a, c, t, g, unknown or other
  misc_feature (470)..(470): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccnccaggctccgagggaaggggctgggagtggggtttcgggtattagtgctcttgatgatagcacatactatgcagactcgtagggccncttcaccatctccagagacaatccaagaacacgactatatctgcagatgaaacacgccgtaggggacgccggaacggacgacggtcccgtttaancctacgtgtcgacgtaaaagattaagttagtaaagtgtaacgttagggtaacgcgttaggaccttaacctacttactttttacgaccgtttaaccggg

SEQ ID NO: 343513 - DNA, 539 bp, Homo sapiens
  misc_feature: GZ8MTXP02J2EC3.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccacgtcccctgtcgctggtcatctatcaagactaccaagccgccctcgacgggactcccccgtgacgcgtattctctcggcctaccaaactcgtagggaacacgacgccacttcacgaccatcacgccggggacccagggctggtgagtggaggctagtaccttattaccgtgtcagggtcggtagggacagcacgcactcgaccctccgttacggaacgtcggaccaacggtccaaccgtcgtacggtcaacgccccaacggacccaaccccg

SEQ ID NO: 343514 - DNA, 595 bp, Homo sapiens
  misc_feature: GZ8MTXP02J3PGG.13.71.G05.1.454.CMB.2.raw
  modified_base (482)..(482): a, c, t, g, unknown or other
  misc_feature (482)..(482): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgagataagtgggataaatatgcttgctggtatcagcagaacgccaggccacgtcccctgtcgctggtcatctatacaagactacaacgccgcctacgaggactccccctgacgcgtattctctggcctacctaaactcgacgggaaccacgacgccctaactcctacgaaccagtccgaacggcccgggggaccctagggcccttaggggtcggaagttggaacggtcctaggtaccttagttaccgtggttaccgagggttccgggnggggaaccacgacgtacgcctaccgtccgtccgtaccgtaccggtacgtacggaccgtaaccggtaccgtaaccgtaccgtacgtaccgaccgacccgaaccgacccgacccg

SEQ ID NO: 343515 - DNA, 593 bp, Homo sapiens
  misc_feature: GZ8MTXP02JA3OP.13.71.G05.1.454.CMB.2.raw
  modified_base (146)..(146): a, c, t, g, unknown or other
  misc_feature (146)..(146): n is a, c, g, or t
  modified_base (289)..(289): a, c, t, g, unknown or other
  misc_feature (289)..(289): n is a, c, g, or t
  modified_base (514)..(514): a, c, t, g, unknown or other
  misc_feature (514)..(514): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggtttcncgttaggctctttaagaggtgtccagtgtcaggtgcagctggtggaatctgggggagcgtggtccagcctggggaatccctgacactgtcttgtgtagcctctggattcagtcttacagaacctatggcatgcactgggtccncaggccccaggcaaggggctggagtggctggacttctttagcatatgatggaatactaaaattcaagtgacagtactacccggtagaaacggggcctaattccgaaccgtccttacccggaaagggtacccaaaccgttacccgaaacggaacccttaaaccttataacgtccttaggacctaggaactcgaacctaggcctagaggaggtcgacgtactcggtntagttactacgtacgtcgtacgaacgaactaacgtagtagtaagttaggttagtaggtggtacgtacgttacgttaccg

SEQ ID NO: 343516 - DNA, 538 bp, Homo sapiens
  misc_feature: GZ8MTXP02G42ZF.13.71.G05.1.454.CMB.2.raw
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccagtcccctgtgctggtcatctatcaagactaccaagccggccctcgagggactcccccgtgagcgtattctcgtggtcctccaactcgtagggaaccacgacgccactctacgaccatcgagccgggacccaggcgttgnggatggaggctgtactattacgtgtcgaggcgtgggacngcagcacgtcgcctccgttacggaacgtcgggaaccgtacggtacctaaccggtccgtaacggtccaccgacccgaacggaccccaaaccccg

SEQ ID NO: 343517 - DNA, 527 bp, Homo sapiens
  misc_feature: GZ8MTXP02G2TQ8.13.71.G05.1.454.CMB.2.raw
  modified_base (224)..(224): a, c, t, g, unknown or other
  misc_feature (224)..(224): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcggtggtccagcctggggntaaaaccctgacactgtcttgtgtagcctctggattcagcttcagacctatggcatgcactggtccgccacggccccgaggcgaaggggctggagtggctgactcgtttatcatatgatggaagtacaaaattctatgacagactcgtgaacgggccattccgaccgtctaccgagggaccaactaccaacgaacaccttatactctagacagatagaacagcctagagaggtacgacgcgtcgctgtactacttncgtnacgacaacntagaagttaggttggagtgtatgtagtttaaccg

SEQ ID NO: 343518 - DNA, 518 bp, Homo sapiens
  misc_feature: GZ8MTXP02GTJNU.13.71.G05.1.454.CMB.2.raw
  modified_base (330)..(330): a, c, t, g, unknown or other
  misc_feature (330)..(330): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggagcgtggtccagcctggggaatccctgacactgtcttgtgtagcctctggattcagcttcagaacctatggcatgcactgggtcccgccaggccccaggcaaggggctggagtggctgacttctttancatatgatggaatacaaaattcatgcagactccgtgaagggccatcaccgtctccaggacaactaccaagaacaccttatatctgacagatagaacagcctagagaggtgacgactcggctgtactaccgttntgtcgacgtacaaaacngtagaagttggttaggagtggacttggttagtttaacc

SEQ ID NO: 343519 - DNA, 548 bp, Homo sapiens
  misc_feature: GZ8MTXP02IO9OY.13.71.G05.1.454.CMB.2.raw
  modified_base (290)..(290): a, c, t, g, unknown or other
  misc_feature (290)..(290): n is a, c, g, or t
  modified_base (332)..(332): a, c, t, g, unknown or other
  misc_feature (332)..(332): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaatccctgacactgtcttgtgtagcctctggattcagcttcagacctatggcatgcactgggtcccncacggccccaggcgaaggggctggagtggctgacttctttancatatgatggaagtactaaaattctaatgcaagactccgtaggaacggcctattccaccgtctaccgaggacaactaccaagaacaccttatatctgacagatagaacacgacctgagaggtgacgactcggcttaggtactacgttgtcgtacgacgtaacaaacgtatagtaagttaggtttaggtagtaggtacgttgttacggtttaacccg

SEQ ID NO: 343520 - DNA, 571 bp, Homo sapiens
  misc_feature: GZ8MTXP02FNQTB.13.71.G05.1.454.CMB.2.raw
  modified_base (336)..(336): a, c, t, g, unknown or other
  misc_feature (336)..(336): n is a, c, g, or t
  modified_base (425)..(425): a, c, t, g, unknown or other
  misc_feature (425)..(425): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagtcttcagaacctatggcatgcacgtgggtccgccgaggccccgaggccgaaggggctggagtggctgacttctttancatatgatggaatcaaaattctatgcagtacctccgtagaacggcctattcaccgtctaccgaggacaactaccaacgtaacaccttanatcagtacagatagaacgacgaccgtagaggaggtacggacgacgtcggtacgtagtactacgtttactggttacggacgtaaccaaaacgtgttagtaaggtttacggttagggtaaggtggtaagttcggttacgtttaacccg

SEQ ID NO: 343521 - DNA, 534 bp, Homo sapiens
  misc_feature: GZ8MTXP02IO7H4.13.71.G05.1.454.CMB.2.raw
  modified_base (291)..(291): a, c, t, g, unknown or other
  misc_feature (291)..(291): n is a, c, g, or t
  modified_base (469)..(469): a, c, t, g, unknown or other
  misc_feature (469)..(469): n is a, c, g, or t
  modified_base (508)..(508): a, c, t, g, unknown or other
  misc_feature (508)..(508): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttctgtggctattttaagaggtgtccagtgtgaggtgcaactgttggagtctggggggaggcttggttcaggccgtggggggtccctgagactctcgtgtgcagcctctggtatttagtttagcagttatgccatgagctgggtccnccaggctccgagggagggctgggagtggggtttcggtattagtgctcttgatgatagcacatactatgcagacctcgttaggggcctcttcaccatctccagagacaattcaaagaacacgactatatctgacagatagaacagccgtgggacgaccgaggacgacggtccgtttaanccaactgagtacgaaaagattattagtaatgatggtagntgactactactacttttgacttacgg

SEQ ID NO: 343522 - DNA, 573 bp, Homo sapiens
  misc_feature: GZ8MTXP02FW6X0.13.71.G05.1.454.CMB.2.raw
  modified_base (291)..(291): a, c, t, g, unknown or other
  misc_feature (291)..(291): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagccgtggggggtccctgagactctcgtgtgcagcctctggatttagttttagctagttatgccatgagctgggtccnccaggctccgaggggagggctgggagtggggttcggtattagtgctcttgatgatagcacatactatgcagactcgtagggccncttcaccntctcagagacaatccaagacacgacatatctgacagatagaaacacgcccgtaggggacgaccggaacggacgacgggtcccgtttatccaacgtcggtagaaccgtaaaagtagttaagttagtaaatggtaagtcgggtaagcgtacgaccttaactaaccttacgtttttacgaactttaaccgggg

SEQ ID NO: 343523 - DNA, 672 bp, Homo sapiens
  misc_feature: GZ8MTXP02HF1CO.13.71.G05.1.454.CMB.2.raw
  modified_base (296)..(296): a, c, t, g, unknown or other
  misc_feature (296)..(296): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccaggccgtggggggtccctgagactctcctgtgcagcctcgtcgggttcaccgtcagtcacacctacatgagctggggtcccnccaggcctccgaggggaagggctgggagtgcgttctttctttttattatagtagtggtaagtacactaccgtccgcagactccggtggcgggggtccattccacctatcctaccaagacgacaaacttaccaaagaaccacgtcttcgtttctacaaatgaacagcctagacgacgaccgagtacgaccgaccgggtccggttagttaactttaccgtggttaggaccggtaaggacgggaggttacccgggggaccccctaaaccgggttaaaaccggtttaccctaaccggtaccgttaaacggttcggggtaacccgggttaccgggtacgggggaaccccgtaaaacgggggaacccccgttaaccccgggg

SEQ ID NO: 343524 - DNA, 569 bp, Homo sapiens
  misc_feature: GZ8MTXP02H3ATD.13.71.G05.1.454.CMB.2.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (481)..(481): a, c, t, g, unknown or other
  misc_feature (481)..(481): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttctgtggctattttaagaggtgtccagtgtgaggtgcaactgttggagtcgtggggggaggcttggttcagccgtggggggtccctgagactctcgtgtgcagcctctggtatttagtttagcagttatgccatgagctgggtcccgccgaggcctccgaggggaaggggctgggagttggggtttcgggtattagtgctcttgatgatagcacatactatgcagactccgtagggccncttcaccatcncagagacaataccaaagaacacgactatatcgtgcagatgaaacaggcccgtagggacgccggaacggacgacggtccgtttaacnctacgtgacgaacgaaagtattagttagtaaagtgagttaggtacgtcgtacgtacttacttacgtttacgttttacgaccgtacggg

SEQ ID NO: 343525 - DNA, 582 bp, Homo sapiens
  misc_feature: GZ8MTXP02HCB2W.13.71.G05.1.454.CMB.2.raw
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (439)..(439): a, c, t, g, unknown or other
  misc_feature (439)..(439): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctctggattcagcttcagaacctatggcatgcacgtgggcccgccgacggcccccgaggcgaaggggctggagtggctgtacttctttancatangatagaagtaacaaaattcatcgactaagccgtacgtaggaacgggcctactccaccgtcctacgaggaccaacgtaccaaacgaactaccttaanactctagacagatacgaacacgtcctaggaagtaggtacggacgaccgtcggtactacgttactaccgttgtaggtacgaaccgaactaaaacgtgttagtaagtttggtttacgggagtaggtattaggttactttaacccg

SEQ ID NO: 343526 - DNA, 631 bp, Homo sapiens
  misc_feature: GZ8MTXP02H3OB2.13.71.G05.1.454.CMB.2.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtgaatcgtgggggaggcgtggtccagccgtgggggaactcccgtgacactgtcttgtgtagcctntggattcagcttcagaacctatggcatcgctacgtcgggtccccgccacggcccccagggaccgaaggggctggagtggctgacttntttancatatgataggaagtaataaaatttcaatgactaagaccgttcggtagaacggggcctattcccgacccgtcctacccgaacgggaaccaaccgtaccaaaacgaacctaacctaattactccagactagaactacgaaacaggtaccgtaggaaggtaggtacggacgtaaccgtcggtacctaggttactaccgtttcgacgttacgaaccgtaaactaaaccgtagttaggtaagtttgggtttaacgggacggttggtacgttaggtttacgtttaacccg

SEQ ID NO: 343527 - DNA, 526 bp, Homo sapiens
  misc_feature: GZ8MTXP02HFS0H.13.71.G05.1.454.CMB.2.raw
  modified_base (171)..(171): a, c, t, g, unknown or other
  misc_feature (171)..(171): n is a, c, g, or t
  modified_base (236)..(236): a, c, t, g, unknown or other
  misc_feature (236)..(236): n is a, c, g, or t
  modified_base (442)..(442): a, c, t, g, unknown or other
  misc_feature (442)..(442): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatntactcctggtatcagcagaagtcaggccagtcccctagtgctggtacatcctatcaagatgccaagccggaccctgagggactccccccgtgacgcgattcgtctgggcctccaactcgtaggaactcacgccactctagaccatcagcggtacccaggcagtgatggaggtctaggtactattacgtgtacgaggcgtagggacnggcagccacgtcgcccgtctacgtcgtaccgtacggacgtacggaaccgtacggtccgtaccgtacgtaacgtccgacgacccg

SEQ ID NO: 343528 - DNA, 576 bp, Homo sapiens
  misc_feature: GZ8MTXP02JFZIM.13.71.G05.1.454.CMB.2.raw
  modified_base (291)..(291): a, c, t, g, unknown or other
  misc_feature (291)..(291): n is a, c, g, or t
  modified_base (447)..(447): a, c, t, g, unknown or other
  misc_feature (447)..(447): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggagcttggttcagccgtggggggtccctgagactctcgtgtgcagcctctggtattttagtttagctagttatgccatgagctgggtccnccgaggcctccgaggggaaggggctgggaggttggggtttcggtattaggtgctcgttgatgatagcacatactatcgactagtaccgtccggtacggggccctacttaccgaccatcctaccgagaacgactaacttaccaaagaacacgactanactctgacagtatacgaacgacgccgtagggacgccggaggacgaccggtaccgtttancgtacgtgagtacgaaagtntagtagtangtacgtgtagcgtagactacgtcttacgtttacgactacgg

SEQ ID NO: 343529 - DNA, 679 bp, Homo sapiens
  misc_feature: GZ8MTXP02JV5P5.13.71.G05.1.454.CMB.2.raw
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
  modified_base (636)..(636): a, c, t, g, unknown or other
  misc_feature (636)..(636): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcgaggtgcagctgggtaggaatcggtgggggagcggtggtccaggccgtggggaactccctgaccacgttgttcttgtgtacgcctcgtggtacttcagtcttacaacgtaacctagtcggcatgccacgtcggggccccncgacggcccccgaggaccggaaggggctgggagtcggctacgtactttcttttanactatatacgagtaggaacgttaactaaaaattctaagtcgactaagtaccgttccggtagggaaccggggtaccttacgtacccgtacccgttccgaaccgtaacgggaacccaaacccgtacccgaaaacgtaacctaaaccctttaattactaccgtacgacgtaagacgttacgaaacgtacgaccgtagaggtacggtacgaaccgtacggtacgtacttagtaacttacgttcgtaggtacgaccgtaaacaaacgtnttaggtaagttggtttaggaggtcgtacgttgtaccgtttaac

SEQ ID NO: 343530 - DNA, 592 bp, Homo sapiens
  misc_feature: GZ8MTXP02H2LYB.13.71.G05.1.454.CMB.2.raw
  modified_base (251)..(251): a, c, t, g, unknown or other
  misc_feature (251)..(251): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctntggattcagcttcagaacctatggcatgcacgtgggtcccgccacggcccccgaggcgaaggggctgggagtggctgacttcgttttatcaatatacgagtaggtaagtaactaaaaattctaatgacaagaccgtcgtagaacgggcctattcacccgtctaccgacgggaaccaacctacgaaaacgaaacctaacccttaatacttctagacaagtatacgaaacacgaccgtagaaacggtaggcgaacgtacgtcggacgtagtactaccgttgtgtacgaccgtaaacaaacctagtagtaagttggttaggtagtaggtacttgtacgtttacc

SEQ ID NO: 343531 - DNA, 593 bp, Homo sapiens
  misc_feature: GZ8MTXP02JIGK9.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccacgtcccctgtcgctggtcatctatcaagactaccaagccgcctcgagggactccccgtagacgcgtattctcgtggcctaccaacgtcgtacggaaccacacgcccactctacgaccatacgacggaccggacccgaggcctggtacggaagtcggaggtcctaggtacttacgtttacgtcgtacgacgggtcggtcggggaacaggacaacggtcctacgtccgccccgtttaccgtaccgggaaccggttacgggaacccgtaaacggtcccgaaccggtccgttaacgggccaacgaccccgaaaccggccccaaacccccg

SEQ ID NO: 343532 - DNA, 600 bp, Homo sapiens
  misc_feature: GZ8MTXP02IEUYU.13.71.G05.1.454.CMB.2.raw
  modified_base (348)..(348): a, c, t, g, unknown or other
  misc_feature (348)..(348): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtgaatcgtgggggaggcgtggtccagcctggggaatccctgacactgtcttgtgtagcctctggattcagcttcagaacctatggcatgcacgtcggggtcccgccgacggcccccagggcgaaagggggcctgggaggtggctggtaccttcttttanctatatgaatggaaagtacaaaaaatttctaattgacaagaccgttccgtaggaacggggcctattcccgaccgtctaccgagggaaccaactaccaaacgaactacccttatactctagacagacgtagaacagacctggaaggtaggtcgaacgtacgtcggtactcgtaacttaccgttcgtgtacgacgaaacaaacgtgtagtaagtttaggtttaggaggttagtacgttaggtacgtttaacccg

SEQ ID NO: 343533 - DNA, 617 bp, Homo sapiens
  misc_feature: GZ8MTXP02FVR24.13.71.G05.1.454.CMB.2.raw
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggtttcctcgttagctcttttaagaggtgtccagtgtcaggtgcagctggtggaatcgtgggggagcgtggtccagcctggggaatccctgacactgtcttgtgtagcctntggattcagtcttcagtaacctatggcatgcacgtcgggtccctccgaacggcccccagggcgaacggggctgggacgtggcctgtaacctttcttttantatagtagtagtaaggaaataactaaaattctaagtcgacagtaccgtaccgaggaacggtctactaccgaccgtacctacgaacggaacctaaccgtaccgaaactaacctacttaatactactacgacgaagtaacgtacgaacgacgtaccgtaggacggtaggtacgaccgtacgtacgtacgttacgttacttacgttcgtacggtacgtaacgaaacgtaaactgtagtaagttggttaggacgtagtactgttacgtacg

SEQ ID NO: 343534 - DNA, 561 bp, Homo sapiens
  misc_feature: GZ8MTXP02H0YT9.13.71.G05.1.454.CMB.2.raw
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagcctctggattcagcttcagaacctatggcatgcactgggtcccncgacggccccaggcgaaggggctggagtggctgactntttancatntgataggatacaaaattcaatgcagacctcgtagaggcatccacgtctcaggacaactacaagaacacttatatactagacagactagaactagcctagacgaggtacgacgtaacgtcggtacgttacgtacttacgttcttacgtacgacgtaaaccgaaaacgtagtaggttaagtttacggttagggtacggtaggtagttacggttacggtttaacccg

SEQ ID NO: 343535 - DNA, 636 bp, Homo sapiens
  misc_feature: GZ8MTXP02FOYL5.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccacgtcccctgtgcgtggtcatctatcaagactaccgaagccggaccctcgacgggactcccccgtagacgcgtacttccgtaccgtcgggtcctacccaaacgtccgtacgggaaacaccgacgccctaactccgtacgaccctagtaccgaacggacccgggaccctagggtccttgggtacggatacgggacgggtcttaaggtaactttacgtttaacgtcggtaccgaaggggtcggacgggacaggaccgacgacctaccgtccggcccttacccggttacggaaacggttaccggggaacctacgggtacccaaccggttccgtaacggtaccgaaccgaccccgaacggaccccctaaacccg

SEQ ID NO: 343536 - DNA, 556 bp, Homo sapiens
  misc_feature: GZ8MTXP02HTQ09.13.71.G05.1.454.CMB.2.raw
  modified_base (351)..(351): a, c, t, g, unknown or other
  misc_feature (351)..(351): n is a, c, g, or t
  modified_base (438)..(438): a, c, t, g, unknown or other
  misc_feature (438)..(438): n is a, c, g, or t
  modified_base (491)..(491): a, c, t, g, unknown or other
  misc_feature (491)..(491): n is a, c, g, or t
  modified_base (528)..(528): a, c, t, g, unknown or other
  misc_feature (528)..(528): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcagcctggggggtccctgagactctcgtgtgcagcctctggtatttagtttagcagttatgccatgagctgggtcccgcaggctccgagggagggctgggagtggggtttcggtattagtgctcgttgatgatagcanatactatgcagactacgttacgggccgtacttccacctagtcctaccagaacgacaaacgttaccaaacgtaacacgactatactcngacagaatgaacaggcctaggggacgaccggaggaaccgacggtaccgtttanacgactgtacgacgaaaagtatattagaatgagtgancgtgactactactactttacgactacgg

SEQ ID NO: 343537 - DNA, 526 bp, Homo sapiens
  misc_feature: GZ8MTXP02F0I70.13.71.G05.1.454.CMB.2.raw
  modified_base (334)..(334): a, c, t, g, unknown or other
  misc_feature (334)..(334): n is a, c, g, or t
  modified_base (410)..(410): a, c, t, g, unknown or other
  misc_feature (410)..(410): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaacctatggcatgcacgtgggtccgccacggcccccaggcgaaggggctggagtggctgacttctttancatatgatggaatacaaaattctatgcagactccgtagaaggccatcacgtctcgaggacactacaagaacactanactctagcagactagaacagcctagagaggtagacgagtcggctagtactacttctagtcgacgtaaccaaacatagtaagttggtttaggagttggtacgttgtacgtttaaccg

SEQ ID NO: 343538 - DNA, 712 bp, Homo sapiens
  misc_feature: GZ8MTXP02IXJNP.13.71.G05.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataagttggggataaatatgnttgctggtatcagnagagccgaggccagtcccctgtcgcgtggtcatctatcaaagactaccgaaggcccgccctacgaggtactcccccgtagcgtatccgtcgtcgtcctcctacgtcgtaggaaacctacgacgccctacgtctacgaaccctagtaccgacgggcccgggacccgaggggtccgttagggttacgggagtcgggtaacgggtccgttacggtaaaccgttttacgtttaccggtacgggttacccggtaaagggggtcccggggttaacgggggtaacccgacgggtaccgaacgggtacccgaacccgttccccgggggtccccctaccggtttaagtcccgggttaccggtttaccccggggaaaacggttccggggaaacccgtaaaacgggttcccccgtaaacggttcccccgttaaaaggtcccgaaacccgggtaccccgaaaacccccggg

SEQ ID NO: 343539 - DNA, 570 bp, Homo sapiens
  misc_feature: GZ8MTXP02HP4RC.13.71.G05.1.454.CMB.2.raw
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggataaatatgcttgctggtatcagcagaagccaggccagtcccctgtgctggcatctatacaagataccaagcggcctcagggactccccctagcgtatctctcggtctccaactctcggacgacacgacactctnaccgtancgcgacgggaccgacgcgtgtgggtagngaggtcgtagtacgtattacgtagtcggacggacggtacggacggacgagtacgacgtaccgtcgtcccgtccgttaccggtaacggtaccgggtaccgtaacggtaccgtacccgtaaccggtacggtaccgtaccgaacccggaacccgaacccgtaaccccgtaacg

SEQ ID NO: 343540 - DNA, 529 bp, Homo sapiens
  misc_feature: GZ8MTXP02FPX37.13.71.G05.1.454.CMB.2.raw
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
  modified_base (452)..(452): a, c, t, g, unknown or other
  misc_feature (452)..(452): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtgggttttcctcgttgctcttttaagaggtgtccagtgtcaggtgcagctggtggaatctgggggagcgtggtccagcctggggaatccctgacactgtcttgtgtagcctctggattcagcttcagaacctatggcatgcactgggtccnccaggccccaggcaaggggctggagtggctgacttctttancatatgatgaagtacaaaaattctatgcagactccgtgaacggcattcacgtctcgaggacactacaagactaccttanactctagcagatagaacagccagagacggtgacgactccggtntacgtactacgttgtacgtacgacaactaaacagtagtaagttaggttacggtaggtagtagtacgttacgttaccg

SEQ ID NO: 343541 - DNA, 634 bp, Homo sapiens
  misc_feature: GZ8MTXP02JITWT.13.71.G05.1.454.CMB.2.raw
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttctgtggctattttaagaggtgtccagtgtgaggtgcaactgttggagtctgggggagcttggttcaggcctggggggtccctgagactctcgtgtgcagcctctggtatttagtttagctagttatgccatgagctgggtccncaggctccgagggagggctgggagttgggttcggattagtgctnttgatcgatagcacatactatgacagtacgttccggttaaggggccctctttacccacctaattccacccaagggaacacctaaagtttccccaaaaaggacccgaacgtacctaataacgttcccagacgagtaagtacgaacgacggtacggtacgggacggaccggaaccggaccggtaccggttaccgttacgttaccgtacgtacgtacggtaacggtaaagtaagttaacgttaagttaagtagtagtaggtacgtcgtacgtactacttaacgtttacgtttacgttacgtacgg

SEQ ID NO: 343542 - DNA, 677 bp, Homo sapiens
  misc_feature: GZ8MTXP02IS4RN.13.71.G05.1.454.CMB.2.raw
  modified_base (532)..(532): a, c, t, g, unknown or other
  misc_feature (532)..(532): n is a, c, g, or t
  modified_base (578)..(578): a, c, t, g, unknown or other
  misc_feature (578)..(578): n is a, c, g, or t
  modified_base (602)..(602): a, c, t, g, unknown or other
  misc_feature (602)..(602): n is a, c, g, or t
tcagtcacgtactacacgaccggtgctcgatttagtgtcgtcgcaagagagaggagcccagcccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggagcttggttcagccgtgggggtccctgagactctcgtgtgcagcctcgtggtatttagtttagctagttatcgccagtgagtcgtcgggtccgccgaggtcctaccggaaggggaaggggtcgtggggtaggtttcgggggtttacggttagtttaggtcggtccgtttcttggtatgaagttagacaactattaacctagtcgacaacgtaccgttaccgggttacggggcccgttccttaccgaccctactccgtaaccgagaacgaacctaaactacccaaaagtaaccactactaaattcgcctagacagtaactaggaaacncgggtccgaggggacgacccggaaggacccgtacgggttccttaanccgagttgaacgtaacgtaaagtnttaagttagtaatacgagtttacggactcgtagtaccttaaccttacgtttacgttttacgaaccgtttacgggg

SEQ ID NO: 343543 - DNA, 776 bp, Homo sapiens
  misc_feature: GZ8MTXP02GSPOW.13.71.G05.1.454.CMB.2.raw
  modified_base (302)..(302): a, c, t, g, unknown or other
  misc_feature (302)..(302): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggaggtcttggttcaggccgtggggggtccctgagactctcgtgtgcacgcctcgtggtattttagtttagctagtttatgccatgagtcgtgggtcccnccgaggcctccgaggggaaggggctggggtaggttggggtttcgggtatttaggtgtcttcgttagatcggtaatagctaacgaattactatcgactacggtaccgttaccggttacggggccctcgttaccaacctatccctacaagacgactaaacttacccaaaagtaaccaacgtactactataccgtgactaagaaacttaggaaacctacgggtaccgtcgggggaaacggaccccggaaagggaaaccccgtacggggttacccccggtttttaaacgtacccggttaaacgttcggttaaaaccggaaaacggttaaaaacgtttagtttaaacgggtttaaaggttaaaacggttaggtaaacgggttacgggttaacgtaacccggtttaaacgtaaacccgttttaaaaccgtttaaaccgtttttaacggttttaacccggtaaaaccggtttaaccggggg

SEQ ID NO: 343544 - DNA, 578 bp, Homo sapiens
  misc_feature: GZ8MTXP02JZQIL.13.71.G05.1.454.CMB.2.raw
  modified_base (253)..(253): a, c, t, g, unknown or other
  misc_feature (253)..(253): n is a, c, g, or t
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
tcagtcacgtactacacgaccggtgctcgatttagtgtcgtcgcaagagagaggaggccagcactaggagtcggtggtgtttccattcggtgatcagcagtgaacacagaggactcaccatggagtttgggctgagctgggttttcctcgttgctcttttaagaggtgtccagtgtcaggtgcagctggtgaatcgtgggggaggcgtggtccaggccgtggggaactccctgacactgtcttgtgtagcctntggattcagtcttcaagaacctatcggcatgcacgtcgggtcccgccgacggccccgaggcggaaggggctaggaggtggactgtacttctttanctatatgagtaggaatactaaaattctaangacagtaccgtcgtagacgggacctatccaccgtcaccgaggaccaactacaaacgactacttatactcagtacagtatacgaacacggactagaggtaggtacgacgacgtcggactagttacttacgtcgtagtacgacgtaacaaacgtagttagtaagttaggttaggtagtaggtacgttaggttacgttaaccg

SEQ ID NO: 343545 - DNA, 732 bp, Homo sapiens
  misc_feature: GZ8MTXP02IA5KL.13.71.G05.1.454.CMB.2.raw
  modified_base (312)..(312): a, c, t, g, unknown or other
  misc_feature (312)..(312): n is a, c, g, or t
  modified_base (510)..(510): a, c, t, g, unknown or other
  misc_feature (510)..(510): n is a, c, g, or t
tcagtcacgtactacacgaccggtgctcgatttagtgtcgtcgcaagagagaggagcccagccctgggatttttcaggtgttttcatttggtgatcaggactgaacagagagaactcaccatggagtttgggctgaactggtctttttcttgtggcttaattttaagaggtgtccagtgtgaggtgcaactgttggagtcgtgggggaggtcgttggttcgagtccgtcggggggtccctggagtacttcgtcgtgtgcacgccttcgtggttattttagtttagctagttatcgcatgagcgtgggtcccncaggctaccgaaggggagggctggggtagtgggtcggacgttagttaaaacggtagaagactagtgggtaccgaaacaacgcgtaaacctacgtaggttcctacccggtaaggaaaaggccgtatactttacaccttatcctaagaatagacttagaaacctaaagaaaagtaaatagtaataacttactacgtaaanaaactaaagtaaacgaaaacctaaaacgaaaggaaaacggacgaaacggtaacgaacggtaacggtacgttacgttaacgttaaccgtaacgtaaacccgaaagtaacggtacggtaacgggaactaaaggaactaccgaaacgtaaccgggccggaacccggtaacgtaaccgggttacggtaaccggaacccggttaacgggggtacccggggaacccgg

SEQ ID NO: 343546 - DNA, 548 bp, Homo sapiens
  misc_feature: GZ8MTXP02G11E3.13.71.G05.1.454.CMB.2.raw
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagtggggataaatatgcttgctggtatcagcagaacgccaggccacgtcccctgtcgctggtcatctatcaagactaccaagccggaccctcgagggactcccccgtgacgcgtattccgtacgttcgcctccaactcgtagggaaccacgacgcccaacgtctacaccaatcgacgccgggacccaggcctggtggatggacggctagactattacgtgtcgaggcggtcggcacgagcacgccactccgccttaccgtacggaccgtcggggtaaccaacggttccgacccgtcgtacggtccgaacgcccgaaacggaccccc

SEQ ID NO: 343547 - DNA, 538 bp, Homo sapiens
  misc_feature: GZ8MTXP02H5HKW.13.71.G05.1.454.CMB.2.raw
  modified_base (148)..(148): a, c, t, g, unknown or other
  misc_feature (148)..(148): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttccncgttgctcttttaagaggtgtccagtgtcaggtgcagctggtggaatcgtgggggagcgtggtccagcctggggaatccctgacactgtcttgtgtagcctctggattcagcttcagaacctatggcatgcactggggtcccncacggccccaggcaaggggcnggagtggctgactctttancatangatggaatacaaaattcaatgacagacctccgtagaacgggcctattccgaccgtctccagacgaactaacttaccaaagaacacgtctgtttacttacaaatgaacagcctgacgagccgatcgacacggcgtagtatactggtagcgagtagacgtcggggacccaacggtaacgttactacgctacgtcggaacgtcgg

SEQ ID NO: 343548 - DNA, 707 bp, Homo sapiens
  misc_feature: GZ8MTXP02G93R8.13.71.G05.1.454.CMB.2.raw
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggtgtccagtgtcaggtgcagctggtggaatcggtgggggagcgtggtccaggccgtggggaactccctagactactgtcttgtgtagcctcgtggtattcagtccttacacgtaacctgtggctagtcgcctacggtccggggtccccaccggacggcccccgagggcgaaggggtcctgggtacggtggaccttggtaacctttcgttttaatactaattagtcggtaagtaggtaaacttaaactaaaaagtttctatcggactaacggtaccgttacggaggaaaccgggtcctaacttacccgacccgttacctaccggaacggaacctaaccgtacccaaacgtaaccctaacttactactacacgactacgagtacgaactacgaccgtaggagtacggtacgaacgtcgtacgtcgttagtacgttacgttcggtaggtaaccgaaccggtaaaacctaaaacggtaagttaggtaacggtttagggtttacggggacggttacggttaggttaccgtttacggtttaaccccg

SEQ ID NO: 343549 - DNA, 637 bp, Homo sapiens
  misc_feature: GZ8MTXP02IU5JW.13.71.G05.1.454.CMB.2.raw
  modified_base (532)..(532): a, c, t, g, unknown or other
  misc_feature (532)..(532): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttctgtggctattttaagaggtgtccagtgtgaggtgcaactgttggagtcgtgggggaggcttggttcagccgtggggggtccctgagactctcgtgtgcagcctctggtatttagtttagctagttatgccatgagctgggtccgccaggcctccgaggggagggctggagtggggtttcggtattagtgctcttgatgatagcacatactatgacagtaccgttaccggtacggggcccgtacttaccgaacctactccctacccaagaacgtaacctaaacttacccaaaagaaacccaccgtaccttaatactctcggacaagactagaaaccgacgtccggtagggacggacccggaagggacccgaccgggtaccgttttanaccgtaccgttggagaaccggaaaagtattaagttagtaaagttgaacgttggtaacgtccgttagtaccttaacttactttcgttttacggaacctttacgggg

SEQ ID NO: 343550 - DNA, 684 bp, Homo sapiens
  misc_feature: GZ8MTXP02GFDCV.13.71.G05.1.454.CMB.2.raw
  modified_base (278)..(278): a, c, t, g, unknown or other
  misc_feature (278)..(278): n is a, c, g, or t
  modified_base (416)..(416): a, c, t, g, unknown or other
  misc_feature (416)..(416): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
  modified_base (630)..(630): a, c, t, g, unknown or other
  misc_feature (630)..(630): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactggttggagtcgtgggggaggtcttggttcaggccgttcggggggtccctggagactcgtcgtgtgcgcgtctgtagttagttttagttancttagttagtcgacagtgacgtcggtccgggtcccacgcgtccgtacgggaaggggacggcggtaggggtcgggtttggggtttacggttaagttggtcgtcgttgttagagtagaagtacgactataacctatacgngactacgttaccgttaacggggtaccgggcccttaccgtaacctactaccttcaaccgagtaaaccgaacttaaacgtacgaaaaccgaacacttaaactattacncggtaanagtaagacgaacgaacggtcggacgggacgggaaccggacggaaccgtacggttaccgttcgttacgacgtagtagaacgtaaaacgtattacgttagtanagtacgtacggactacgtctacgtacttacttactttacgtacgtacggtacgg

SEQ ID NO: 343551 - DNA, 629 bp, Homo sapiens
  misc_feature: GZ8MTXP02G37I8.13.71.G05.1.454.CMB.2.raw
  modified_base (188)..(188): a, c, t, g, unknown or other
  misc_feature (188)..(188): n is a, c, g, or t
  modified_base (279)..(279): a, c, t, g, unknown or other
  misc_feature (279)..(279): n is a, c, g, or t
  modified_base (325)..(325): a, c, t, g, unknown or other
  misc_feature (325)..(325): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcgtggtttccgtcgttaggctcttttaagaggtgtccagtgtcaggtgcagntggtggaatcgtgggggagcgtggtccagccgtggggaatcccgtgacactgtcttagtgtagcctgtggattcgagcttcgaagaacctncggcatgcgacgtcggccgccgacgccgacggacggacggcgtggngtgtcgtcgtacttacttatatatagtacgtagtagtaacgtaaactaaatactacgtcgtacgacgtacgtacgtacggacggtacgtacgtaccgtaccgtaccgtacgaacgaacgtaaccgtaacgaaacgtaactaactaactactacgtacgtacgtaacgtaacgtacgaacgacgacgtacgacgtacgtacgtacgtacgtacgtacgtacgtacgtacgttacgtacgtacgtaacgtaacgtaacgtagtagtaagttaggtacggtacgtacgtacgttacgttacgttacg

SEQ ID NO: 343552 - DNA, 614 bp, Homo sapiens
  misc_feature: GZ8MTXP02IVP4R.13.71.G05.1.454.CMB.2.raw
  modified_base (292)..(292): a, c, t, g, unknown or other
  misc_feature (292)..(292): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctggggggaggcttggttcagccgtgggggtccctgagactctcgtgtgcagcctctggtatttagtttagctagttatgccatgagcgtgggtccncgaggctccgaggggagggctgggagtgggtttcggtattgtgcttgttgatgatagcacactactatgacagtaccgttccgtagggccgtcttcaccatctaccagacgacaacttaccaagaacacgactatatctgacagatacgaacgacggtccgtaggggacggacccggacggaaccgtacgggtccgtttaagtccgtaacgtggtacgaacggtaaaagtaagttaacgtttaagtaaagtaggtaacgtgggttaacgtcgttacgtaccttaacgttaactttaccgtttttagtaccgtttaaccgggg

SEQ ID NO: 343553 - DNA, 616 bp, Homo sapiens
  misc_feature: GZ8MTXP02FPIOA.13.71.G05.1.454.CMB.2.raw
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctctggattcagcttcagaacctatggcatgcacgtgggtccnccaggccccaggcgaaggggctggagtggctgtacttctttanctatatagagtagaatactaaaattctatcgacagtaccgtcgtagaacgggtcctatccgaccgtccgtaccgacggaacaacctaccaaacgtaacctacttaatactcgtacgacgaagtacgtacgaacgtacgtaccgtaggaacggtacgggtacgaaccggtaccgtacggtacgttaacgttaacgttacgttcgtacggtacgaaccgtaaaacgtaaaacgtagttagtaagttaggttaggtaaggttcggtacgttacgttacgttaaccg

SEQ ID NO: 343554 - DNA, 644 bp, Homo sapiens
  misc_feature: GZ8MTXP02H1NQF.13.71.G05.1.454.CMB.2.raw
  modified_base (184)..(184): a, c, t, g, unknown or other
  misc_feature (184)..(184): n is a, c, g, or t
  modified_base (478)..(478): a, c, t, g, unknown or other
  misc_feature (478)..(478): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtncagctggtgaatcgtggggagcgtggccagccgtggggaactcctgacactgtcttgtgtagcctctggattcagtcttacagaacctatcggcatcgactacgtcgggtccccgccgacggcccccgagggacgaacggggctgggagtcggctacggtacttcttttaagctaatagtacgagtacggaaagtaactaaaaatttcgtaatcgaacacgtaccgtacggtagaacgggctaacgtccacgtcctacgaacgaaccaacctaccaaagtaacctaaaccttanactacgtagtacaagtacgtaacgaaaacgcgaccgtaggaacggaggttaccgacgtaccgtcgtacttaacggttacttacgttacgtcggtaacgaccggtaaactaaacgtgttagtaaggttaggtttaggaggttagtacgtttggtttaacgttaaccg

SEQ ID NO: 343555 - DNA, 644 bp, Homo sapiens
  misc_feature: GZ8MTXP02INX9L.13.71.G05.1.454.CMB.2.raw
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (412)..(412): a, c, t, g, unknown or other
  misc_feature (412)..(412): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttgggagtcgtgggggaggcttgggttcaggccgtggggggtcccctggagtactctcgtgtgcacgcctgtggtatttagttagctagttatgccatgagcgtcgggtccgcaggctaccggaggggagggcgtgggtaggttggggttcgggtattagtgtcttgtgntgatagcaactactactancgactagtaccttcggtacgggcctactccaccnctcacagactaacaacttacaaacgaacacgtactaatactcgtagactaagaacgtacgaaactaccgggtcgtacggggacgacccggaaagggaacccgtacccggggttaccttacgtaccgtaacgtgtaacgaaacggtaaaagtagttaattaaggtaaacttggaacttgggtaactcgtacgtactaaccttacgtttacgtttaccgtaacgttacccgggg

SEQ ID NO: 343556 - DNA, 627 bp, Homo sapiens
  misc_feature: GZ8MTXP02GLMQ5.13.71.G05.1.454.CMB.2.raw
  modified_base (289)..(289): a, c, t, g, unknown or other
  misc_feature (289)..(289): n is a, c, g, or t
  modified_base (513)..(513): a, c, t, g, unknown or other
  misc_feature (513)..(513): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtggggagcttggttcagccgtgggggtccctgagactctcgtgtgcagcctctggtatttagtttagctagttatgccatgagctgggtccnccagctcgaggggaggctgggagtggggttcggtattagtgctctgatgatgcatactatatcgacagtaaccgttcgggttacggggccctacttccaccctagtccaccaagaacgacctaaacgttaccaaagaaccacgactatactcgtcgacagatacgaaacgacgtaccgggtagggaccggaccgaacgggtacgacccgggttaccgttttaancccgtaacgttacgagtaaccgtaaaaggtattaacttaaggttaaagtaccgtagtaggttacgccttacggtaccttaacctacgtttacgttttacgaaccttaccggggg

SEQ ID NO: 343557 - DNA, 595 bp, Homo sapiens
  misc_feature: GZ8MTXP02HF1GS.13.71.G05.1.454.CMB.2.raw
  modified_base (288)..(288): a, c, t, g, unknown or other
  misc_feature (288)..(288): n is a, c, g, or t
  modified_base (466)..(466): a, c, t, g, unknown or other
  misc_feature (466)..(466): n is a, c, g, or t
  modified_base (537)..(537): a, c, t, g, unknown or other
  misc_feature (537)..(537): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttctgtggctattttaagaggtgtccagtgtgaggtgcaactgttggagtctgggggagcttggttcaaccgtgggggtccctgagactctcgtgtgcagcctctggtatttagtttagctagttatgccatgagcgtgggtccnccgaggcctccgaggggaaggggctgggaggttggggtttcggtattaggtgtctcttgatgatacgcaactatacctatgcaggtactccggttaaggggcctacttacaccgatcctaccgagacgaactaattaccaaagaacacgactaatactctagacagaactacgaaacncgccgtaggggacgccggaaggaccgacggtccttaagcgacgtgtagacgtaaaacgattagttagtaanagtagtaggtagtctcgtaccttacttacttacgttttacgacgttacggtaccgggg

SEQ ID NO: 343558 - DNA, 597 bp, Homo sapiens
  misc_feature: GZ8MTXP02GR3EO.13.71.G05.1.454.CMB.2.raw
  modified_base (293)..(293): a, c, t, g, unknown or other
  misc_feature (293)..(293): n is a, c, g, or t
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
  modified_base (562)..(562): a, c, t, g, unknown or other
  misc_feature (562)..(562): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggcttttcttgtggctattttaagaggtgtccagtgtgaggtgcaactgttgggagtcgtgggggaggcttggttcaggccgtggggggtccctggagactctcgtgtgcagcctctggtatttagtttagcagttatgccatgagctgggtccnccaggctccgagggaggggctgggaggtggggtttcgggtattaggtgctcgttgatgatagcacatactatgacagaccttaccggttagggggccctcgtttaccaaccctataccctcccaaaggaacgaacctaaacttacccaaaagaaccaacgtacctaatactctagacaagatagaaacagccgtagggacgccggaaggaccgtaccggtcgtttacncgacgtgtacgacgaaaagtntaagttgtaaatgatggtangtcgacttacgtacttacttttcgaacttacgggg

SEQ ID NO: 343559 - DNA, 633 bp, Homo sapiens
  misc_feature: GZ8MTXP02FS6CW.13.71.G05.1.454.CMB.2.raw
  modified_base (497)..(497): a, c, t, g, unknown or other
  misc_feature (497)..(497): n is a, c, g, or t
tcagtcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttggggaataaatatgcttgctggtatcagcaagaagccgaggccacgtccccgtgtcgcgtggtcatctatacaagatacccgaaggcccggccctacgaacgggactcccccgtagacgacgtacttccgtcttcgggtcctaccaacgtcgtacgggaaccacgaccgccacgtctacgaccactcgacggaccggacccgaggccgtagggtggagtaggaggtcgtagtacttagttacgtcgtacggacgggtacggtaggggaacnggacgacgaccgtacgtccggtcccgttaccggttaaccgggaaaccgttacggggaaacccgtaacgggtacccgtaaccggttaccggtaacggtaccgaaccggaccccgaaaccgggcccctaaaacccccg

SEQ ID NO: 343560 - DNA, 605 bp, Homo sapiens
  misc_feature: GZ8MTXP02FJOE0.13.71.G05.1.454.CMB.2.raw
  modified_base (254)..(254): a, c, t, g, unknown or other
  misc_feature (254)..(254): n is a, c, g, or t
  modified_base (536)..(536): a, c, t, g, unknown or other
  misc_feature (536)..(536): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggaggcttggttcaggccgtggggggtcccctgagactctcgtgtgcagcctntggtatttagtttagctagttatgccatgagcgtcgggtccgccaggctccgaggggaggggctgggagtggggttcggtatagtgctgtgatgatagcacgatactatgacagtaccttacggttagggccctcttaccaccctatctaccagtaaacgaactaaacttacccgaaaagaaaccacgtacttatactcctagacaagtatacgaactacgccgtaggggaacgacgaacggaacacggttaccgtttagcctagtgacgaacgtaaaagtnttaacgttaagtaagtgtagtacggtatcgtacgtacttaactacgtttaccgtttagaccgttacggg

SEQ ID NO: 343561 - DNA, 567 bp, Homo sapiens
  misc_feature: GZ8MTXP02H9Z60.13.71.G05.1.454.CMB.2.raw
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
tcagtcacgtactacacgaccggtgctcgatttagtgtcgtcgcaagagagaggagcccagcccctgggattttcaggtgttttcatttggtgatcaggactgaacagagagaactcaccatggagtttgggctgaactggctttttcttgtggctattttaagaggtgtccagtgtgaggtgcaactgttggagtcgtggggaggcttggttcagccgtggggggtccctgagactctcgtgtgcagcctctggtatttagtttagctagttatgcatgagcgtgggtccnccgaggcctaccgaggggaagggctgggagtggggtttcggtattagtgctnttgatgatacgcanatactatnacagactccggttaggcctnttacacccatccgacagacgaacaaattcaaagaaacncgntataactcagcagaananacagacgaggacggacgacgacgacgtacgttactactacgtagtagacgaaagtataagttaagtaagtagtagtagtagtaacgtacgtactacttaacgttacgtttacgttacgtacg

SEQ ID NO: 343562 - DNA, 601 bp, Homo sapiens
  misc_feature: GZ8MTXP02IXQRN.13.71.G05.1.454.CMB.2.raw
  modified_base (352)..(352): a, c, t, g, unknown or other
  misc_feature (352)..(352): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgactactgtcttgtgtacgcctcgtggattcagtcttcagaacctagtggcatgactacgtcgggtccccgccgacggcccccgagggcgaaggggcctagggagtcggctgtacttctttanctatatgagtaggaaatactaaaattctatgctaacgtccgtaccgtggaacgggtcctacttccgaccgtctaccgacggggaacctaaacctaccaaacgtaaacctaccttaatactctagactaagagtacgaacagtcctaggaggtaggtcgaacgtacgtcggtacttgttactacttcgtcgtacgacaacgtaaactgtagtaagttaggttaggtagttggtagttcgttacgtttacc

SEQ ID NO: 343563 - DNA, 642 bp, Homo sapiens
  misc_feature: GZ8MTXP02JQYOM.13.71.G05.1.454.CMB.2.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (354)..(354): a, c, t, g, unknown or other
  misc_feature (354)..(354): n is a, c, g, or t
  modified_base (538)..(538): a, c, t, g, unknown or other
  misc_feature (538)..(538): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcggtgggggaggcgtggtccaggccgtgggggaactccctgacactgttcttgtgtagcctcgtggattcagtcttcacgacctagnggcatgcacgtgggtcccnccgacggccccgaggacgaggggtctggaggtggcgttacgactttcgtttanacgtattagtacgtagtaggtaaacgtaactaaaattcgaacgtgaccgtaacgtacccgtcgtaaggggaacggtacctacgttacccgaccggtaccctacccgggaacggtaacccaaaccgtacccaaagaacccttaacttaatacgtcagtcaacgtataacgactacgacgtagagnggtacacgtacgtagcgttacgttaatccgttgtcggtacgaaccgtaactaacgtagtattaaggttaggtacggtggttagtagttacgttacgttaacccg

SEQ ID NO: 343564 - DNA, 604 bp, Homo sapiens
  misc_feature: GZ8MTXP02HHMFL.13.71.G05.1.454.CMB.2.raw
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (540)..(540): a, c, t, g, unknown or other
  misc_feature (540)..(540): n is a, c, g, or t
  modified_base (567)..(567): a, c, t, g, unknown or other
  misc_feature (567)..(567): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagccgtggggaatccctgacactgtcttgtgtagcctntggattcagcttacagaacctatcggcatgcacgtgggtcccnccgacggcccccgaggaccgagggcgtggngtgctgactttctttatcgaatagtagagtaggtaaataactaaaattctaatcgacagacctaccgtaaggaacgggcctactacccgtacccgtcaccgaaggaaccaaaccctacgaaaacgaacctacttaatagtacctagacctaaggactaacgactacgctaggaggacggtacgtaacgacgtccggattacgttacttaccgttntacgtaccgaacgaaaactaaacgtanaggttaagtggtttaggagtggtactgttacgttacc

SEQ ID NO: 343565 - DNA, 701 bp, Homo sapiens
  misc_feature: GZ8MTXP02JSC3H.13.71.G05.1.454.CMB.2.raw
  modified_base (527)..(527): a, c, t, g, unknown or other
  misc_feature (527)..(527): n is a, c, g, or t
tcagtcacgtactacacgaccggtgctcgatttagtgtcgtcgcaagagagaggacgcccagccctgggattttcaggtgttttcatttggtgatcaggactgaacagagagaactcaccatggagtttgggctgaactggtcttttcttgtggctattttaagaggtgtccagtgtgaggtgcaactgtggagtcgtggggagcttggtcagccgtgggggtccctgagctctcgtgtgcagcctcgtgtatttagtttagctagttatgcctatgagcgtcgggtcccgccgaggccgtaccgaaggggaacggggtcgtggggtaaggtttggggtttacgggtagttaggtgtcgttcgtttagattaggtaatacgacctaactactaacctagtcgtaccgaacgtacccgtaccggttaacggggtccctaccttaccaccctaatccgtacccaagaaccgtaaactaacttaacccgaaagtaaaccacgtactactactaccctagacctaaggtanacgtaaacgacgtcccgagggacccggacgaacggtaccgacccggttacgttactctaacgttgaacgggaaaccgaaaagtaatttacggtaagttaaaccgtggtaacgtggtaacgtcgtaacgcctttaaacgttaacgtttaccgttttacgacggtttaacccgggg

SEQ ID NO: 343566 - DNA, 659 bp, Homo sapiens
  misc_feature: GZ8MTXP02JMWUY.13.71.G05.1.454.CMB.2.raw
  modified_base (281)..(281): a, c, t, g, unknown or other
  misc_feature (281)..(281): n is a, c, g, or t
  modified_base (561)..(561): a, c, t, g, unknown or other
  misc_feature (561)..(561): n is a, c, g, or t
  modified_base (614)..(614): a, c, t, g, unknown or other
  misc_feature (614)..(614): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtcttttcttgtggctattttaagaggtgtccagtgtgaggtgcaactgttggagtcgtgggggagcttggttcaggccgtggggggtcccctggacgactcgtcgtgtgcagcctcgtggtattttagtttagctagttancgccatgagtcgtcgggtcccgcgacggccgtaccgaaggggaggggctggggtaggttggggtttcggtattaggtgccttgttgatgaatacgacacattactagtcgactacgtaccgttaccggttacggggccctacctaccacccgtactcctaccgaagtaacgaactaaactaccgaaacggaacctacgacttaataacgttccagaacgtataaagtacgaaaactcgggacccgtaggggaccgaccgaacgaccgtacggtcgttacncgtacgtgaacgaacgtaagtattaacgtagtaaacgtgtacgtaggtacgtntaccgtaccttaacgttaccgtttacgtttacgaaccgtaccggg

SEQ ID NO: 343567 - DNA, 734 bp, Homo sapiens
  misc_feature: GZ8MTXP02I6GNU.13.71.G05.1.454.CMB.2.raw
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttcttttaagaggtgtccagtgtcaggtgcagctggtggaatcggtgggggaggcggtggtccgaggccgtagggggaactcccgtagacctacgttgttcttggtgtacgtccttcgtaggatttcagtccttacgaacgtaaccctagtcggactagtcgccgtacggtccgggtccccgcccgaccggccccgaagggaccggaaggggccgtgggaggtcggcgttgtacctttacttttacgctaattagtagtacgttaggtaaacttaaaactaaaattctaagtcgacgtaacggtaccgtaccggtaggaaccgggtacctacttacccgtacccgtccgtacccggacggtaaaccctaaccgtaacccgaaacgtaaaccccttaacttactactacgtacggtacaacgtaagtacgaaaccgtacgggtacccgtaaggacggtaacgggtaccggaaccggtaccgttcgggtactacgtttaccttacggttcgtacgtacgaaaccgtaaacctaaagtcgtaagtgtttaggtagaggttagtagttacgttacgttaaccc

SEQ ID NO: 343568 - DNA, 612 bp, Homo sapiens
  misc_feature: GZ8MTXP02I2KNO.13.71.G05.1.454.CMB.2.raw
  modified_base (292)..(292): a, c, t, g, unknown or other
  misc_feature (292)..(292): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtcttttcttgtggctattttaagaggtgtccagtgtgaggtgcaactgttggagtcgtgggggaggcttggttcaggccgtgggggtccctgacgactctcgtgtgcagcctctggtatttagtttagctagttatgcatgagctgggtccnccgaggctccgaggggagggctggggtaggttggggtttcgggtatttaggtgcttcgttgatgatagctacatactatgactagaccgttaccggtacggggccctcgttaccaccactcctaccagaacgactaacttaccaaagaactacgactatatcagacagtatagaaacacgtccgtagggacgaccgaacggacgtacggttaccgttaactccgagttggacgacggtaaaagagtttaagttagtaaagttccgagttaggacgtcgtacgtacttaacgtactttacttttacgaccgtttaccgggg

SEQ ID NO: 343569 - DNA, 804 bp, Homo sapiens
  misc_feature: GZ8MTXP02IHY27.13.71.G05.1.454.CMB.2.raw
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgcttctttttaagaggtgtccagtgtcaggtgcagctggtgaagtcgtgggggagcgtggtccaggccgtggggaactccctgacacttgtcttgtgtacgctcgtggtacttcgagtcttacacgtaacctagtcggctagtcgcctacggttcgggccccaccgaccgggaccccgaggggaaccggaagggggtcgtaggggtacggtcggtcgttacggtaactttactttttacgactaaagttagttaggtaagttaagggtaaaacttaaaaccttaaaaaagttttctaacgttacgaaacgttaaacgggtaccccttaccggggtaaacggtaaaccggggtcccctttaacgttacccccgtacccggttacccgttaacccgggaaacggtaaaccctaaaaccccgttaaacccgaaaaaccgtaaaccccgttaaacctttaaaacttaccgtacccgttaaaggtaccgaaaagttaacgtaacggaaaacgttcggaccgtaagggaacgtacgggtacgtacggtaccgtaccggtagtttaccgttacgttacgtttcgacgtaccgaacgaaaacaacgttagtagttaaggtttaggttacggtagtacgtacgtttagtttaccgtaacg

SEQ ID NO: 343570 - DNA, 740 bp, Homo sapiens
  misc_feature: GZ8MTXP02F0CQS.13.71.G05.1.454.CMB.2.raw
  modified_base (359)..(359): a, c, t, g, unknown or other
  misc_feature (359)..(359): n is a, c, g, or t
  modified_base (391)..(391): a, c, t, g, unknown or other
  misc_feature (391)..(391): n is a, c, g, or t
  modified_base (522)..(522): a, c, t, g, unknown or other
  misc_feature (522)..(522): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgctcttttaagaggtgtccagtgtcaggtgcaggctgggtaggaagtcggtggggggaggtcggtggtccaggccgtgggggaactccctgacactgtcttgtgtacgcctcgtggtattcgacgtcttacgaacgtaacctagtcggactatcgaccacggtcgggtccccgccgaccggaccccggaggacggaacggggtcgnggggtacggtcggtctagtacctttactttanctaagttagtcgtaagtaggtaaataaacttaaaacttctaagtcgtacaacggtacgtacggtaggaacgggtcctactccgaccgtcaccggaacgaactaacctaacaaacgtaactacttaataacnctaacgacaaaggtaactaacgaaacgaccgttaacgaggaaacgggtacggaacgaaaccgtacggtccggttaacgttacgtttaacgtttacgtttcggtcggggttaaaccaacccgtaaaacgttaaaaacgtcgtttaaggtaaggttttagggggtttaacgggtaggttacccggtttaagtttccggggtttaacccttttaaacccgg

SEQ ID NO: 343571 - DNA, 554 bp, Homo sapiens
  misc_feature: GZ8MTXP02FL6AK.13.71.G05.1.454.CMB.2.raw
  modified_base (291)..(291): a, c, t, g, unknown or other
  misc_feature (291)..(291): n is a, c, g, or t
  modified_base (438)..(438): a, c, t, g, unknown or other
  misc_feature (438)..(438): n is a, c, g, or t
  modified_base (492)..(492): a, c, t, g, unknown or other
  misc_feature (492)..(492): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaatccctgacactgtcttgtgtagccctctggattcagcttcagaacctatggcatgcactgggtccnccgacgccccaggcgaaggggctggaggtggctgacttctttaatcatatgatagaagtacaaaaattctatgacagtaccgtcgtagaagggcccgtatttaccaccgtctaccgacgggacaacctaccgaaacgaacaccttanatctagcagactaggaacagcctagagacggtgacgacgtcggctgtactactntaggtacgacgtaacaactagtagaagttacgttgggtaagttggtacttagtcgtttaacc

SEQ ID NO: 343572 - DNA, 596 bp, Homo sapiens
  misc_feature: GZ8MTXP02JX11D.13.71.G05.1.454.CMB.2.raw
  modified_base (365)..(365): a, c, t, g, unknown or other
  misc_feature (365)..(365): n is a, c, g, or t
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactgttggagtcgtgggggagcttggttcagccgtggggggtccctggagactctcgtgtgcagcctgtggtatttagtttagctagttatgccatgagcgtgggtcccgcctaggcctccgaggggaaggggctgggaggttggggtttcggtattaggtgtcttctggatgatagcanactactatgacagaccgtaccgttaggggccctcttaccacctactcctaccagaacgaactaaattaccaaagaacacgactatatactgacaagatagaaacgacgccgagggacgaccggaacgacgaccggtacgtttactcacgtgtacgaacgaaaagtattagttagtaagtagacgtggtagcgtcgtacttacgtacttacgttttacgacgttaaccgggg

SEQ ID NO: 343573 - DNA, 769 bp, Homo sapiens
  misc_feature: GZ8MTXP02HVEAA.13.71.G05.1.454.CMB.2.raw
tcagtcacgtactacacgaccggtgctcgatttagtgtcgtcgcaagagagaggagcccagccctgggattttcaggtgttttcatttggtgatcaggactgaacagagagaactcaccatggagtttgggctgaactggtctttttcttgtggctattttaagaggtgtccagtgtgaggtgcaactggttggagtcgtgggggagcgtttggttcagccgtgggggtccctgagactctcgtgtgcgcgtcctgtgttagttttagttagacttagttatcgacgtagtacggacgtcggtccgggtcccgacggaccggtcccgtacggggaaggggacgggtcggtaggggttggggtttaccggggtttaggttaagttcggtcgttccgtttgttagtagtagtagtacgactaactaccgttaatcgtacgacgtaacgttacccgggttaaccggtacgggtcccttacctacccaccgttacttacccgaacgaacggtaaccctaaactttaaacccgaacaaaaccgtaacccgtacgttaccttaaagtccttacgcgttaaacgaacgtaacgttaccgaaaccgtccgggtaacgggtagggaccgggtaaccggacggacccgtaacgggtttttcaactaccgttggaagtaacgaaaagtattagttaaaagtgtaaagtcgggttatacgggtaacttgttacctaaccggttactttaacgtttacgtacggtaacccgtttaacggggg

SEQ ID NO: 343574 - DNA, 704 bp, Homo sapiens
  misc_feature: GZ8MTXP02IZHZ0.13.71.G05.1.454.CMB.2.raw
  modified_base (366)..(366): a, c, t, g, unknown or other
  misc_feature (366)..(366): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggttttcctcgttgctcttttaagaggtgtccagtgtcaggtgcagcgtggtggaatcgtgggggagcgtggtccagccgtggggaactccctgacatgtcttgtgtacgcctgtggtacttcagtcttcagtaacctagtcggcatcgccacggtcgggtccccgccgaccggccccgagggcgaacggggctgggagtcggccttaggtacctttcgttttaanctaattagtagtaagtaggtaaactaacgtaaaaatttctaagtcgactacgtaccgtaccgtagggaacggtccgtattaccgaccgtacgtaccgaacgggaacctaaaccgtaccgaaaccgtaaacctaaccgttaactacgtccgtagtaacctaaaggtaacgtacgaaaccctacggtaccgtaggaacgggacgggtaacgaaccggtaccgttcggacgtttaacggttaacttacgttacgttcggtacgaaaccgtaaactaaaacgtgttaggtaaggtttaggtttacgggtacggttaggttacgttaggtttacgtttaaccg

SEQ ID NO: 343575 - DNA, 688 bp, Homo sapiens
  misc_feature: GZ8MTXP02JMUKV.13.71.G05.1.454.CMB.2.raw
  modified_base (404)..(404): a, c, t, g, unknown or other
  misc_feature (404)..(404): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaactcccgtgacactgtcttgtgtagccttctgggtattcagtcttcagaacctatggcatgccacgtggtcccgccgaacggcccccgtagggaccgaagggggtcctggggacgtgggcccttaggaccttcgttttatccattacgcgtagtagggtaaatacctaaaaagttctaagngtaccgagtaaccgttcccgaggtaaccggggtctcgttacccacccgtttccgacccgtaacgggaccctaaacgtacccgaaacgtaaaccctaaccgtttaatacgttaccttagaccaaggttaataccgaacgtacgtacccgtaggaccgaagggtcgacgacgtcggtaccgtgttaacgtacgtttctacggtacgtaccgtaaaccgtaacgtaaagttcgaagtttagggtttacggttaagggtgttacggttcccgtttaggtttaaacccg

SEQ ID NO: 343576 - DNA, 624 bp, Homo sapiens
  misc_feature: GZ8MTXP02JJEJ2.13.71.G05.1.454.CMB.2.raw
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggaggcgtggtccagcctggggaactccctgacactgtcttgtgtagcctcgtggattcagcttacagaacctatggcatgcacgtcgggtcccgccgacggcccccaggcgaaggggcgtggaggtcggctgtacttcgtttatctatagtcgagtaggaatactaaaattcaatgacgacgacgttccgagaacgggtacctagttacccgaccgtaccgtaccgaacgggaacctaacgtaccaaacgtaaaccctaccttaatactctacgactaaggactacgaacgacgtacgtagaggtaggtcgaccgtacgtcggtactacgttacgtactttgtacggttacgacgtaaacctaaacgtagttagtaagtttacgggttaggttacggtggtacgttaggttacgtttaaccg

SEQ ID NO: 343577 - DNA, 610 bp, Homo sapiens
  misc_feature: GZ8MTXP02IFY4K.13.71.G05.1.454.CMB.2.raw
  modified_base (352)..(352): a, c, t, g, unknown or other
  misc_feature (352)..(352): n is a, c, g, or t
  modified_base (357)..(358): a, c, t, g, unknown or other
  misc_feature (357)..(358): n is a, c, g, or t
  modified_base (373)..(373): a, c, t, g, unknown or other
  misc_feature (373)..(373): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttgggtttttcctcgtttgcttcttttaagaggtgtccagtgtcaggtgcagctggtggaatcggtgggggaggcgtggtccaggccgtggggaactccctgacactgttcgttgtgtacgtccttgtggtattcagtctttcaagaacctagtggcagtgctacgtgggtccccgcgaccggcccgaggcgaaggggctggagtgctgtacttntttannatatcgatagataanaaaattctatgcaagccgtcgagaacggtcctagttccaccgtctacgacggactaaacctacgaaacgtaacctaaccttagtactcgacgacaacgtataacggaactacggcctaagggagtacggtagaaccgtacggtcgtacgttattacgttacgttcgagtaccgacgtaaactaaactgttagttaagtgggttaagtaggttaggtactttaggtttaccttaaccg

SEQ ID NO: 343578 - DNA, 684 bp, Homo sapiens
  misc_feature: GZ8MTXP02FIO2J.13.71.G05.1.454.CMB.2.raw
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggtttcctcgttgctcttttaagnggtgtccagtgtcaggtncagctgggtggaagtcgtgggggaggcgtggtccaggtccgtggggaactcccgtggaacctacgtgttccttggtgttacgcccttgtaggattcgagtcttacgagaaacctgtcggacatcgcacgtcgggcccnccgaacggccccgaggtacgaagggggctaggaggtcggacgtcggtactttcttttaanactaatagtagtacgtagtaaactaaactaaaagttcgtatcgacgacgtaccgtaccggaaggaacggtaccttaacttacccgacgttaccacgaagtaacaaccgtaaactaccgaaacgtaaccgtacgttacgttacgtttactaaccgtaaagtacgaacgtacgtaccgtaagacgaaccggtcgtaagtaccgacgtacggtacgtacgtaactcggtagtacggagacggacggtaccggaccggaaccgtaaacgtaccgttaacgaccgtacgtacggtacggtacggtaccgg

SEQ ID NO: 343579 - DNA, 719 bp, Homo sapiens
  misc_feature: GZ8MTXP02GJDAP.13.71.G05.1.454.CMB.2.raw
  modified_base (365)..(365): a, c, t, g, unknown or other
  misc_feature (365)..(365): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaactccctgacactgtcttgtgtacgccttcgtggattcgagtcttcaacgtaacctagtggcatcgactacgtgggtcccgccgacggccccgaaggccgaacggggctgggaggtcggtactacgtacgtttacttttaanaccgtaattagtggtagtaagggtaaacgtaaactaaaaactttccgttaaagcgttacaacgttaccgtacccgggttaagggaaaccgggcctaacttacccggacgttcccgaaccgtacgggaaaccaaccgtaccgaaacgtaacctaaccgttaatactcgtacggactaaagacgtacgaaacgacgtacccgtaaggaacgggtacggtacggaaccgtaccgttacggacgttacggttaacttacgttaccgtaggttacgacccggttaaaaccaaacgtacgttaggtaagtttaaggtacggggtaacgttaggtccgttaacggttagtttaaacccccg

SEQ ID NO: 343580 - DNA, 528 bp, Homo sapiens
  misc_feature: GZ8MTXP02HC2NX.13.71.G05.1.454.CMB.2.raw
  modified_base (156)..(156): a, c, t, g, unknown or other
  misc_feature (156)..(156): n is a, c, g, or t
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (497)..(497): a, c, t, g, unknown or other
  misc_feature (497)..(497): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctnttttaagaggtgtccagtgtcaggtgcagctggtggaatctgggggagcgtggtccagcctggggaatccctgacactgtcttgtagtagcctntggattcagcttcagaacctatggcaatgcactggtccgccacggcccacgcaagggacgtgagtggctgactctttattntatatnatagagtaataaaatatatgtacagacgtacgtagaacggacgactcacgtacgacgagacaactacaaacgaactaactaatatactanacagatagaanacgacgagagagtagacgacgtacgtactgtactatactacgtagacgaacaaactaanagtaagtgttagtagtagtactagtactacg

SEQ ID NO: 343581 - DNA, 593 bp, Homo sapiens
  misc_feature: GZ8MTXP02IKMB9.13.71.G05.1.454.CMB.2.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (322)..(322): a, c, t, g, unknown or other
  misc_feature (322)..(322): n is a, c, g, or t
  modified_base (338)..(339): a, c, t, g, unknown or other
  misc_feature (338)..(339): n is a, c, g, or t
  modified_base (371)..(371): a, c, t, g, unknown or other
  misc_feature (371)..(371): n is a, c, g, or t
  modified_base (465)..(465): a, c, t, g, unknown or other
  misc_feature (465)..(465): n is a, c, g, or t
  modified_base (491)..(491): a, c, t, g, unknown or other
  misc_feature (491)..(491): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagcttggggttttcctcgttgcttcttttaagaggtgtccagtgtcaggtgcagctggtgaatcgtgggggagcgtggccagcctgggaatccctgacnctgtcttgtgtancctntggattcagcttcagaacctagtgcatgccacgtgggtccccgccacggccccgaggcgaaggggctggcgnggctgtacttctttannatagtcgagtaggtaatactaaaagttcttancgacagtaccgtaccgtagggaaccggccttactccgtaaccgtcctaccgaaggaccaaaccgtacaaaacgtacctaacttatactgtacanaacgtatacgaagcacgtgaaacggnggtacgacgtacgtcggtactagttactcgtttcgagtacgaacgaaacgtaaactgtaagtgtttgggtaacggtggtacgttagttagttacgttaaccg

SEQ ID NO: 343582 - DNA, 731 bp, Homo sapiens
  misc_feature: GZ8MTXP02GQ5LP.13.71.G05.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
tcagtcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgcttcttttaagaggttgtccagtgtcaggtgcagctggtggaatcgtgggggagcgtggtccagcctggggatcctgacactgtcttgtgtagcctntggattcagcttcagacctatggcagtgcacgtgggtcccnccaacggcccccaggaccaaggggtctggacgtggcttaggaccttntttttaagcaatagtaccgtagaggtaagttacctaaaaatttcctaagtcgacgaaggtaaccgttacccggtaggggaacgggggtacccctaaagtttcccgaacccggttacccgttacccggaaaacgggggtaaccctaaacccgtacccgtaaaaccggttaaaccaacccccgttttaaataaacccgttcgttacggtacaaacgtaaacgttccgaaaaccgaacgtccccgttaaggaaacgggtacgggttacgaaaccggtacgtaccggggctttacgggttacttaaccgtttccgtaaggttcgaacgtaaaccgaaaaccgtgttagtaacgttaggtttacggtacggttaggtatttccgggtaatttaacccg

SEQ ID NO: 343583 - DNA, 569 bp, Homo sapiens
  misc_feature: GZ8MTXP01DJ4WZ.41.84.H07.1.454.CMB.2.raw
  modified_base (350)..(350): a, c, t, g, unknown or other
  misc_feature (350)..(350): n is a, c, g, or t
  modified_base (521)..(521): a, c, t, g, unknown or other
  misc_feature (521)..(521): n is a, c, g, or t
tcagtctatactatcacgaccggtgctcgatttagcagacgtctgtcgcggggagctctgagagaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtcgtgggggaggattggcacagccgtggggggtccctgagactctcctgtgcagcctctggcttccccttaggagctatgccatgacctgggtccgccaggctccgaggggaaggggctcgagtgggtctcgacaattggcgntagtcgcaactgacacaatactaacggagagtccgtgaacgggccgcttcaccatctccagagacaattaccggaaacactacttttctaggaaatagaacagcctagagagtacgaagacacggtccctttattctgtgcggtaagggaggggggacttggatccgacgnggttggggtggggtggtcgaacgtccgttggggccgaaggggaaccgg

SEQ ID NO: 343584 - DNA, 598 bp, Homo sapiens
  misc_feature: GZ8MTXP01BPV5Z.41.84.H07.1.454.CMB.2.raw
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
tcagtctatactatcacgaccggtgctcgatttagcagacgtctgtcgcggggagctctgagagaggagcccagccctgggattttcaggtgttttcatttggtgatcaggactgaacagagagaactcaccatggagtttgggctgaggtggcttttcttgtgactatttaaaggtgtcagtgtgaggtggcctgttggagtcgtgggggaggattggcacagccgtggggggtccctgagactctcctgtgcagcctctggccttcccctttaggagctatgccatgaccgtgggtccgccgaggctccgagggggacggggctcggaggtgggtctcgacagttggcgctagtgcaactgacacaataacgtcgggagtacggtcccgtaggaacgggcccgacttccaccatcctacccagacgaacaacgttacccggaaactacctactttttctaggaaattagaacagcctagagtagtacgaagacgaccggtcctttatttcgtggtgcggtaagggnggggggacngggtacgtccgacgttaggttggggtggggtggttcgacgtccggttggggcgaagggccg

SEQ ID NO: 343585 - DNA, 932 bp, Homo sapiens
  misc_feature: GZ8MTXP01CIU71.41.84.H07.1.454.CMB.2.raw
  modified_base (255)..(255): a, c, t, g, unknown or other
  misc_feature (255)..(255): n is a, c, g, or t
tcagtctatactatcacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgacttaattttaaaaggtgtccagtgtgaggtggcctgtggagtcgtggggagatggcacgagccgtgggggtccctgagctctcctgtncagcctctcggtccttcccgttaggagctatcgcctagtcggaccgtgggtcccgccgacggccgtcccggaagggggaacgggggtctacggaggttacggggtctacggaacgtaagttcgggcgtcgttaggtaccggacctaaacgtcggaaaccaccgtaaaacgtttaaacccggtaacgggggaaagggtaacccgggttcccggggttaacggggaaaccgggggtcccccgttaccgtttaacccgaaaccccgtaacgttacccctaacccgaaacgggaaaccgtaaacccgttaaaaccgtttaacccccggggtaaaaaaccttaacccggttttaaacctttttttaaccgtaaaggggttaaaactttaccgggaaaaccggtacggttaaccccgttaggaaacggttaacgggttaaaccggaaaccggtaaacccggtttaacccgggtttaaccccttttttaacgttttccgttaacggggtttcgggtaaacccggggaaaggggggttaaacggggggggggtaaccgttacggggtaaaccgtcccggttaaacggttacggggttggggggtttaacgggggtttaccgggttaacccgtaaccgggttcccggggttacgggggtaaccccggaacgggggtaacccccggg

SEQ ID NO: 343586 - DNA, 761 bp, Homo sapiens
  misc_feature: GZ8MTXP01A77AE.41.84.H07.1.454.CMB.2.raw
  modified_base (314)..(314): a, c, t, g, unknown or other
  misc_feature (314)..(314): n is a, c, g, or t
tcagtctatactatcacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgactaattttaaaaggtgtccagtgtgaggtggccctgttggagtcgtgggggagattggcacagccgtgggggtccctgagactctcctgtgcacgccctcgtcggtcctttccccgttaggagctatcgccaatcgacctgggtccnccgaggcctccgagggggaacgggctcgaggtgggtctcgactagttcggcgtcgtagtcgactaactgaacacaactaacgtcggagtacggtccgtagggaaccgggtcccgtcttaccacctaatccgtaccgagaacgactaaacgttaccggaaactaccgttaacctttttacgaaacgggtaaaacttacgggaaactacggtacccgtaggtaaacgtacggtaaccgaaacggtaccgttaaacccgggttccccttttaaagtttcgtacgggttacgggaaggggtaaacggggggttacggggggtaccgttagggtaacccgttacccggttaaacgggttcggggttggggggtttcggggtttacgggttaacccggttaacccggttccgggggttaaccgggggccccggttaaacggggggttccccgg

SEQ ID NO: 343587 - DNA, 720 bp, Homo sapiens
  misc_feature: GZ8MTXP01AVUDH.41.84.H07.1.454.CMB.2.raw
tcagtctatactatcacgaccggtgctcgatttagcagacgtctgtcgcggggagctctgagagaggagcccagccctgggattttcaggtgttttcatttggtgatcaggactgaacagagagaactcaccatggagtttgggctgaggtggtctttttcttgtgactattttaaaaggtgtccagtgtgaggtggcctgttggagtcgtgggggagagttggcacgagccgtgggggtcctgagactctcctgtgcagtcctcgtcggtccttccccgttaggcgctatcgccagtcgaccgtcgggtccgccacggcctccgagggggaagggcctaggaggtggtcctgaacgtaagttggcgtctagtcgactaacgtagacaacaataaccgtaacgggatacggtccgggtagaacggggccctacttacccgacctagttcctaccgagacgaacgtaacttaaccggaaactacgttactttacaggtaaatacgaacgtacgaccgtagacggtaagtaccggaagtaccgtaccgttacccttttaagtttcgtacgggttaggaaccggggtaaagggggttaccgggggggtaattacgggtaacggtaccccggaagttgggggttacgggggtttaacggggttcgggttaaccgtaaccggttcccggggttagggggaacccggttaaacgggggtccccggg

SEQ ID NO: 343588 - DNA, 610 bp, Homo sapiens
  misc_feature: GZ8MTXP01DRMEF.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctcctttagtagttatggatgaacgtgggccccgcgaggcgtccgggggaagggccggagtgggtggaccaacataagtgacaaagagtaggaactagaagaaaaacgtgtagggggactacgtgtggaagggcccgtattacacctatctaccaagacgaaccaaaccggtaagtaaacctttacgttagtttacctagacaaatacgaaacaagccctaggggaacggacggaccggagggaccacgggtcttaggttagttatttagttggtggcggaaagggcagggtggcgtgggacagttggacgtgaggggcaagggcacggtcaacgtcc

SEQ ID NO: 343589 - DNA, 559 bp, Homo sapiens
  misc_feature: GZ8MTXP01CXBCV.19.48.E04.1.454.CMB.2.raw
  modified_base (529)..(529): a, c, t, g, unknown or other
  misc_feature (529)..(529): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactggccccgcaggctccgggggaaggggccggagtgggtggccaacataatgacaagatggaactgaagaaaaactgtagggggactcgtgtgaaaggggcccgagttccaccatctaccagagacaaacgtaagaacttactgtttctgacaaatgaacagcctggagagccgagacacggctgtgtattgtgtgcggaagggcaggtggcgtggggacagttggacgttcgnggggccaaggggccacgggtcaaccggtcc

SEQ ID NO: 343590 - DNA, 558 bp, Homo sapiens
  misc_feature: GZ8MTXP01B5RSF.19.48.E04.1.454.CMB.2.raw
  modified_base (435)..(435): a, c, t, g, unknown or other
  misc_feature (435)..(435): n is a, c, g, or t
tcagtactctcgtgcacgaccggtgctcgatttagagagcgtcacagagagaaggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttatggatgaactgggcccgcaggctccgggggaagggccggagtgggtggccaacataatgcaagatggaactgaagaaaactgtggggactcgtgtggaaagggccgattcaccatctccagagaacaacgtaagaacttactgtttcngacaaatgaacagcctggagagccgaggacacggctgtgtattagtgtgcggaagggcaggtggcgtgggacagttgggacgtcgtgggggcccaaggggacccacgggtccaacccggttcc

SEQ ID NO: 343591 - DNA, 594 bp, Homo sapiens
  misc_feature: GZ8MTXP01EML8O.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagccgtggggggtccctgagactctcctgtacaggctctgggttctctttagtagttatggatgaactgggcccgcaggcgtccgggggaagggccggagtgggtggccaacataatgacaagatggaactggaagaaaaactagtgggggactcgtgtggaagggccgattcaccatctaccagacgaacaaaccgtaagaaccttactagtttctagacaaatgaaacagcctagggagagccgaggacacggctgtagtattagttggtgcggaaagggcaggtggcgttgggggaaccaggttcgggaacgttcggtagggggaacccgaaaggggaccccgacgggtccgaacccggttccc

SEQ ID NO: 343592 - DNA, 556 bp, Homo sapiens
  misc_feature: GZ8MTXP01EWPCX.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctctttagagttatggatgaactgggccccgccaggctccgggggaaggggccggagtgggtgccaacataatgacaagatggaactgaagaaaaaactgtgggggactcgtgtggaagggcccgattcaccatctccagagacaaaccgtagaacttactgtttctgacaaatgaacagcctggagagccgaggacacggctgtgtattatgtgcgaagggcaggtggcgtggggacagttgggacgtgtggggccaaggggaccacgggtccaaccggtcc

SEQ ID NO: 343593 - DNA, 554 bp, Homo sapiens
  misc_feature: GZ8MTXP01BVQF9.19.48.E04.1.454.CMB.2.raw
  modified_base (339)..(339): a, c, t, g, unknown or other
  misc_feature (339)..(339): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (550)..(550): a, c, t, g, unknown or other
  misc_feature (550)..(550): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagcctggggggtccctgagactctcctgtacaggctctgggttctctttagtagttatggatgaactgggcccgcaggcgtccgggggaagggccggagtgggtgccaanataatgacaagatggaactggaagaaaaaactagtagggggactacgtgtggaaggggcccgattccaccatctaccagagacaaaccgtaagaacttactgtttctagacaaatgaacagcctggagagccgaggacacggctgtgtattatgtgcgaagggnaggtgngtggangttggacgtggcgggaacgagggaccgacggtccncgtc

SEQ ID NO: 343594 - DNA, 585 bp, Homo sapiens
  misc_feature: GZ8MTXP01BKQPK.19.48.E04.1.454.CMB.2.raw
  modified_base (302)..(302): a, c, t, g, unknown or other
  misc_feature (302)..(302): n is a, c, g, or t
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcttggtccagccgtggggggtccctgagactctcctgtacaggctcgtgggttctcctttagtagttatggatgactggcccncaggctcgggggagggccgagtgggtgccaacataatgacaagataggaactgaagaaaaactagtaggggactcgtagtggaagggcccgattcaccgatctccagacgaacaaccgtaagaacttactgtttactagacaaatgaaacagccctagggaagacggaccgaggaccacggctgtagtattagttggngacggtaagggcaggtcgggngtagggacaggttcggacggtcggtcggggaaccgaacggggaccgaccggtcccgaaccgtcc

SEQ ID NO: 343595 - DNA, 618 bp, Homo sapiens
  misc_feature: GZ8MTXP01BJG3P.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggaggcttggtccagccgtggggggtccctgagactctcctgtacaggctcgtgggttctctttagtagttatggatgaactcgggcccgcaggcgtccggggaaggggccggagtgggtggccaaacataaatgacaaagagtaggaactagaaagaaaaactgtagggggactcgtagtggaagggcccgattcacctatctaccaagacgaacaaacgtaagaaacttacgttagtttactagaccaaaagtcgaaacagcctaggggaacggacggaccggaaggacgacggtcgttaggttagttaatttagtggtggacggaaagggcagggtggcgtggggacttaggttcggacggtcgtgggggaaccaaggggccgacgggtccaacccgtcc

SEQ ID NO: 343596 - DNA, 654 bp, Homo sapiens
  misc_feature: GZ8MTXP01EUG71.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcttggtccagccgtggggggtccctgagactctcctgtacaggctcgtgggttctcctttagtagttattggatgaacgtgggccccgcaggcgtccgggggaagggccggaggtgggtggccaacataaatgacaagataggaactagaaagtaaaaactgtagggggactcgtagtggaaaggggccgaatttccgaacctatcctacccgaagacgaaaccaaaccggtaaagtaaacctttacttagttttactagacaaatacgaaacagccctaggggacgacggaccggaggaccacgggcttggtagttattattggtggacggaaaggggcttagggtggaccgtagggggaacaggttcgggaccgtcgggtacgggggaacccgaaacgggggacccgaacgggtcccgttaacccggttcccc

SEQ ID NO: 343597 - DNA, 574 bp, Homo sapiens
  misc_feature: GZ8MTXP01D49SV.19.48.E04.1.454.CMB.2.raw
  modified_base (534)..(534): a, c, t, g, unknown or other
  misc_feature (534)..(534): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttattggatgaacgtgggccccgcgaggcgtccgggggaaggggccggagtgggtggccaacataaatgacaagatggaactagaagaaaaactgtggggactcgtgtggaaagggccgattcaccatctccagagaacaaacgtaagaacttacttgtttctagacaaatgaaacagcctaggggaagagacccgaaggacgacggctgtagtattagttgtgcggaagggcaggtggcgtggggacngttggacgtgtcggggccaagggccacggtcgaaccgtcc

SEQ ID NO: 343598 - DNA, 618 bp, Homo sapiens
  misc_feature: GZ8MTXP01APVVU.19.48.E04.1.454.CMB.2.raw
  modified_base (578)..(578): a, c, t, g, unknown or other
  misc_feature (578)..(578): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctctttagagttatggatgaactgggcccgcaggcgtccgggggaaggggccggaggtgggtggaccaacataatgacaaagataggaactgaaagaaaaactgtggggactcgtggtgaaacgggccctagttccaccgtatcctaccaagacgaaccaaaccgtaaagtaacctttacgttcgtttactagacaaattcgaaacagcctaggggacgacgccggaggaccacgggcttggtagttattagttgtggcggaagggcagggtggcgtaggggacttaggttcggacgttcgggngggggaacccaagggggccccacgggtccaacccggttcc

SEQ ID NO: 343599 - DNA, 560 bp, Homo sapiens
  misc_feature: GZ8MTXP01DSN12.19.48.E04.1.454.CMB.2.raw
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctctgggttctcctttagtagttatggatgaacgtgggccccgcaggcgtccgggggaagggccggagtgggtggccaacataatgacaagatggaactagaagaaaaactgtggggactcgtgtggaagggccgattcacatctaccagagacaacgtaagaacttactgttctgacaaatgaacagcctgggaagcgcgaggacacggtntgtatattgtgtgnggaaggnaggtggcgtggattaggttggacggtcggtacggggaaccgaacgggaccgacggtccgccgtcc

SEQ ID NO: 343600 - DNA, 571 bp, Homo sapiens
  misc_feature: GZ8MTXP01EEEOI.19.48.E04.1.454.CMB.2.raw
  modified_base (530)..(530): a, c, t, g, unknown or other
  misc_feature (530)..(530): n is a, c, g, or t
  modified_base (564)..(564): a, c, t, g, unknown or other
  misc_feature (564)..(564): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtctgggggagcttggtccagccgtggggggtccctgagactctcctgtacaggctctgggttctcctttagtagttatggatgaactcgggcccgcaggcgtccgggggaagggccggaggtgggtggccaacataatgacaagatggaactgaagaaaaactgtagggggactacgtgtggaaagggccgattcaccatctaccagagacaaaccgtaagaacttacttagtttctagacaaatcgaaacagcctaggagacgccgaggacacggtctgtagtattagttgtgcggtaaagggcttaggtggcgtgggacngttggacgtgtggggccaaggggccacgggtccnccggtcc

SEQ ID NO: 343601 - DNA, 754 bp, Homo sapiens
  misc_feature: GZ8MTXP01B85FX.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctctttagtagttatggatgaactgggcccgcaggcgtccgggggaagggccggagtgggtggccaacataatgacaagatggaactagaagaaaaactgtaggggactcgtagtggaagggacccgtacttacacccaagttcctacccgaagaacgaaccgaaacccgtaaagtaaacctttaacgttacgttttaccgtaggtaacctaaaagtacgaaaccgacgtaccccgttagggggaaacggacggggacccgaaacggggtaaccgaaccgggtccgttaggtttagggtttaattttaaaggtttcggtagggaccgggtaaaagggggccgttaaaggggtttacgggccggttaaggggggaaccttaagggttcgggggttaaaccggttccgggttaccggggggaaccccgaaaacggggggaccccgttaacccgggggtaaccccgttaaccccgggtttccccg

SEQ ID NO: 343602 - DNA, 709 bp, Homo sapiens
  misc_feature: GZ8MTXP01EQ8AG.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaggtgtcagtgtgaggtgcaccgtggtggagtcgtgggggagcttggtccagccgtgggggtccctgagactctctgtacaggctcgtgggttctcctttagtagttattggatgaacgtgggccccgccgaggcgtccgggggaaggggccggaggtgggtggaccaacataatgacgaagagtaggaactagaaagaaaaacgtagtaggggacttacgtggtaaggaacggggacctacgttccgaacctactccttacccgagaacgaaaccgtaaacccggtaaagtaaacctttacgttacgttttacctagtacctaaaattacgaaacacgacccgttaggggaacggaacggaccggaagggaaccgaaccgggtctggttagttatttaagttggtggacgggtaaagggcggttaagggtcgggttacggtgggaccgaggttcggggaccggttcggggtacgggggaaccgaaacgggggacccggttaccgggtaacccgttaacccgggttccccg

SEQ ID NO: 343603 - DNA, 698 bp, Homo sapiens
  misc_feature: GZ8MTXP01AYGHH.19.48.E04.1.454.CMB.2.raw
  modified_base (594)..(594): a, c, t, g, unknown or other
  misc_feature (594)..(594): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacagctcgtggttctccttagtagttatggatgaacgtcgggccccgcgaggcgtccgggggaaggggcccgggaggtgggggtcggaccaacgataagtgacaaagagtaggaactaggaaagtaaaaacgtagtagggggactacgtagggtaaggaaacggggcccgtattccgaaccctattccctacccgaaggaacgaaaccgtaaaacccggtaaagtaaacctttacgttacgttttacctagtaacctaaaagtacgaaacgacgtacccgtaggggaacggacggaccggaaggaccgacggtcgttggttagttattagtttggnggaccggaaagggtcgagggtggccgtaggggacttagggttcgggaccggtcgggtcgggggaacccgaacgggggcccaccgggtcccgaacccggttcccc

SEQ ID NO: 343604 - DNA, 733 bp, Homo sapiens
  misc_feature: GZ8MTXP01DDTT4.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtattttagaaggtgtccagtgtgaggtgcaccgtggtggagtcgtggggggaggcttggtccagccgtggggggtccctgagactctcctgtacaggctctggttctctttagtagttatggatgaactgggccccgcaggcgtccgggggaaggggccggaggtggggtggaccaaacataatgacaagatggaactagaaagaaaaactgtaggggactacgtgtggaaacgggccgaattccaacccatcctacccgaagaacgaaaccaaaccggtaaagtaaacctttaacgtagttttacctaggaacctaaaagttacgaaacaacggaccccgttagggggaaacggaacggggaccccggaagggggaacccgaacccggggtcgttagggttagtttaaagtttaagtttgggtagggacgggtaaaaggggccgttaaggggttcggggacggttagggggaacttaagggttcggggaacccggttcgggtacggggggaaccccgaaaacgggggaccccgttaccggggttcccgttaaccccggttcccg

SEQ ID NO: 343605 - DNA, 549 bp, Homo sapiens
  misc_feature: GZ8MTXP01B3H9G.19.48.E04.1.454.CMB.2.raw
  modified_base (371)..(371): a, c, t, g, unknown or other
  misc_feature (371)..(371): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttattggatgaactgggcccgccaggctccgggggaaggggccggagtgggtggccaacataatgcaagatggaactgagaaaactntggggactctgtgaaagggccgattcaccatctccagagacaaccgtaagaacttactgtttctgacaaatgaacagcctggagagccgaggacacggctgtgtattatgtgcgaagggcaggtggcgtggggacagttggacgtcgtggggccaaggggccacgggtcaaccggtcc

SEQ ID NO: 343606 - DNA, 626 bp, Homo sapiens
  misc_feature: GZ8MTXP01DV1L7.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggaggcttggtccaggccgtggggggtccctgagactctcctgtacaggctctgggttctcctttagagttattggatgaacgtgggccccgcaggcgtccgggggaaggggccggaggtggggtggaccaacataaatgacaaaggataggaaactaggaaagtaaaaaacgtgtacgggggacttacgtagtggaaacggggccgaattccgaaccatctaccgagacgaacaaaccgtaagaaacctttacgttgtttactagacaaatgaaacacgccgtagggagacggacccgaggaaccacgggctgttagtattagttggtagcggaaagggcagggtcggcgtaggacgagttcgggacgttcggcgggggaaccaacggggccacggtccgaaccgtcccg

SEQ ID NO: 343607 - DNA, 589 bp, Homo sapiens
  misc_feature: GZ8MTXP01AKQSH.19.48.E04.1.454.CMB.2.raw
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctcctttagtagttattggatgaacgtgggcccgcaggcgtccgggggaagggccggagtgggtggaccaacataatgacaagatggaactgaagaaaactgtaggggactcgtgtgaagggccattcaccatctaccagacgacaacgtaagaacttactgtttcagacaaatgaaacngacctggggagaggccgaaggacncggctgtagtattagtgtgcggaagggcaggtggcgtagggacttaggttcgggaccggtcggtacgggggaacccgaaagggggacccgaccgggtccgaacccggttcccg

SEQ ID NO: 343608 - DNA, 570 bp, Homo sapiens
  misc_feature: GZ8MTXP01B7F9A.19.48.E04.1.454.CMB.2.raw
  modified_base (447)..(447): a, c, t, g, unknown or other
  misc_feature (447)..(447): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctctttagtagttatggatgaactgggccccgcgaggcgtccggggggaaggggccggaggtggggtggccaacgataatgacaagataggaactagaagaaaactgtggggactcgtgtggaagggccgattcaccatctccagagaacaaccgtaagaacttactgtttacngacaaatgaacagcctagggagagccgaggacacggctgtagtattagttgtgcggaagggcaggtggcgtggggacagttcgggacgtcgtggggccaaggggcccacggtcaacccggttc

SEQ ID NO: 343609 - DNA, 605 bp, Homo sapiens
  misc_feature: GZ8MTXP01CA09C.19.48.E04.1.454.CMB.2.raw
  modified_base (426)..(426): a, c, t, g, unknown or other
  misc_feature (426)..(426): n is a, c, g, or t
  modified_base (508)..(508): a, c, t, g, unknown or other
  misc_feature (508)..(508): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctctgtacaggctctggttctctttagtagttatggatgaacgtgggccccgcgagggccgtccggggggaaggggccgggaggtgggggtcggaccaacaataaatgacaaagagtaggaactaggaaagaaaacgtagtaggggactacgtgtggaagggccattcaccatcnccagagaacaacgtaagtaacttacttagtttcagacaaatgaacagcctagggacgagccgaggacacggctgtagtattnttggtgcggaaaggggcagggtggacgtaggggacaggttcggggacggtcggtcgggggaaccgaacggggacccacgggtccgaacccggttccc

SEQ ID NO: 343610 - DNA, 591 bp, Homo sapiens
  misc_feature: GZ8MTXP01DJ4TU.19.48.E04.1.454.CMB.2.raw
  modified_base (348)..(348): a, c, t, g, unknown or other
  misc_feature (348)..(348): n is a, c, g, or t
  modified_base (497)..(497): a, c, t, g, unknown or other
  misc_feature (497)..(497): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtggggggaggcttggtccaggccgtggggggtccctgagactctcctgtacaggctctgggttctcctttagtagttatggatgaactgggccccgcaggcgtccgggggaaggggccggaggtgggtggaccaanataatgacaagatggaactagaagaaaaactgtagggggactcgtgtggaaagggccgattcaccgtatcctaccagagaacaaacgtaagtaacttactagtttactagacaaatgaaacagcctagggagacggccgaggacacggntgtagtattgtggtgacggaagggcgaggtggcgtggggacagttgggacgtcggtacggggccgaaacggggaccacgggtccgaaccggtcc

SEQ ID NO: 343611 - DNA, 568 bp, Homo sapiens
  misc_feature: GZ8MTXP01BPRZP.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctctttagtagttatggatgaactgggccccgcgaggccgtccgggggaagggccggaggtgggtgccaacataatgacaagataggaactagaagaaaaactgtggggactacgtgtggaagggccgattccactatcctaccagagaaccaacgtaagtaacttactgtttctagacaaatgaacagcctggagagccgaggacaggctgtagtattgtgtgcggaaggcaggtggcgtggggacttagttcggacgtcggtggggccaaggggacccacggtcgaacgtcccg

SEQ ID NO: 343612 - DNA, 771 bp, Homo sapiens
  misc_feature: GZ8MTXP01A2382.19.48.E04.1.454.CMB.2.raw
  modified_base (341)..(341): a, c, t, g, unknown or other
  misc_feature (341)..(341): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctgttggtatttagaggtgtcagtgtgaggtgcaccgtggtggagtcgtgggggagcttggtccaggccgtgggggtccctgagactctcctgtacaggctcgtgggttctctttagtagttattggatgacgtcgggcccgcgaggcgtccgggggaagggccggaggtgggtgaccaanataagtgacaagagtaggaactaggaaagtaaaaacgtggtagggggactcgtaggtaaggaaacggggtcccgtaattcccaaccgtactacctacccgaagaacgtaaaccgtaaaccggttaaacgtaaacctttaacgttacggttttacctaggtaacctaaaagttacgaaacgaacggtcccgttagggggaaaggacgggacccgggaacggggaaccgtaccgggtacgttagggttacggtttaaagtttaaggtttcgggtagggtaaccgggggaaaggggtaccggttaaggggtggggttccgggttagggggaacccgttaagggttcggggttaaccgggttcggggtaccggggggaaccccaacggggggtaccccgaaccgggggttccccgttaaccccgggtttccccg

SEQ ID NO: 343613 - DNA, 647 bp, Homo sapiens
  misc_feature: GZ8MTXP01DDLJI.19.48.E04.1.454.CMB.2.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtgggttttcctcgttggtattttagaaggtgtcagtgtgaggtgcacgtggtggagtcgtgggggagcttggtccaggccgtggggggtccctgagactctcctgtacaggctcgtgggttctctttagtagttatggatgactgggccccgcaggcgtccgggggaagggccggagtgggtggaccaanataangacaagatggaactgaagaaaaactgtgggggactcgtgtggaagggcccgaattcacctatctaccagagaacaacgtaagtaacttactgtttctgacaaatgaaactagcctaggggaacgaggacccggaagggaccgaccgggtcgtggttagttaagtttagttggtggacgggaaaggggtcgaggggttgggcggttagggggaaccttagggttcgggttaaccggggttcggtacggggggaacccgtaaagggggaccccgaacggggttcccaaccccgggtttccc

SEQ ID NO: 343614 - DNA, 674 bp, Homo sapiens
  misc_feature: GZ8MTXP01BOJNJ.19.48.E04.1.454.CMB.2.raw
  modified_base (259)..(259): a, c, t, g, unknown or other
  misc_feature (259)..(259): n is a, c, g, or t
  modified_base (614)..(614): a, c, t, g, unknown or other
  misc_feature (614)..(614): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtatttagaaggtgtccagtgtgaggtgcacgtggtggagtctgggaggaggcttggtccagccgtggggggtccctgagactctctgtacnggctcgtggttctcttagtagttatggatgacgtcgggccccgcgacggcggtccgggggaaggggccggaggtggggtcggaccaacaataagtgacaagagtaggaaacctaggaaagtaaaaacgtggtacgggggaactcgtgggtaggaaacggggcctacttaccacctatacctacccgaaggaacgaaaccgtaaaccgttaaagtaactttacgttgtttacagaactaaagttacgaaacgtacgtccggtaggaacggacggaccgggaaggaccgcggtcgttaggttagttaagtttagttggtaggaacgggtaagggcgtaggttcgggcgtacgggacnggttcgggaaccggttgggaacggggaccggacgggaccgtaaccggttccgtaaccccg

SEQ ID NO: 343615 - DNA, 628 bp, Homo sapiens
  misc_feature: GZ8MTXP01BSG0L.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggagcttggtccagccgtggggggtccctgagactctcctgtacnggctctgggttctctttagtagttatggatgaacgtgggccccgcgaggcgtccgggggaagggccggaggtgggtgccaacataatgacaagatggaactagaagaaaaagtgtaggggactcgtggtggaaacgggccgtattcaccactctaccaagacgaacaaaccgtaaagtaaactttacgttagtttacgtagactaaatgaaacagcctagggacgaggaccgaaggaccacggtctaggttattaagttagttggtagcgggtaagggcagggttggcgttgggaacagttcggggacgttcgggcgggggaacccgaaacgggggacccgttacgggtcccgaaccggttcccg

SEQ ID NO: 343616 - DNA, 725 bp, Homo sapiens
  misc_feature: GZ8MTXP01BO7XF.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacgtggtggagtcgtgggggaggcttggtccagccgtggggggtccctgagactctctgtacaggctcgtggttctctttagtagttatggatgacgtcgggcccgcaggcgtcgggggaagggcggagtgggtgccaacgataatgacaagataggaactagaaagaaaaacgtgtggggactcgtaggtggaacggggtccctaattcccgaacctacgtccctaccgaagtaacgaaaccgtaaaccggtaaacggtaaactttacgtttaggtttacctcgtaaccaaagttacgaaaccgaacgtcccgtaggggaacggacgggaccggaacggggaaccgaccgggtcgtaggtttaggttaagtttaggtttgggtacggtaccggggaaagggggtccgttaaggggttcgggccggttaagggggaaccgttaggttccgggggacggttccggggtacgggggaacccgtaacgggggacccgttaccgggtaacccgttaaccccgggtttcccg

SEQ ID NO: 343617 - DNA, 559 bp, Homo sapiens
  misc_feature: GZ8MTXP01AODI1.19.48.E04.1.454.CMB.2.raw
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (411)..(411): a, c, t, g, unknown or other
  misc_feature (411)..(411): n is a, c, g, or t
  modified_base (447)..(447): a, c, t, g, unknown or other
  misc_feature (447)..(447): n is a, c, g, or t
  modified_base (486)..(486): a, c, t, g, unknown or other
  misc_feature (486)..(486): n is a, c, g, or t
  modified_base (554)..(554): a, c, t, g, unknown or other
  misc_feature (554)..(554): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggaggcttggtccagccgtggggggtccctgagactctcctgtacaggctctgggttctctttagagttatggatgaactgggcccncaggcgtccgggggaagggccggagtgggtggccaanataatgacaagatggaactgaagaaaaactgtggggactcgtgtggaacgggccgattcaccatctccaganacaacgtaagaacttctagtttctgacaaatgaacngcctggagacgccgaggacaggctgtagtattagttggnggcggaaggcaggtcggcgtgggattaggttcggacgtcggcggggaaccgaacgggaccacggtccnccgtc

SEQ ID NO: 343618 - DNA, 607 bp, Homo sapiens
  misc_feature: GZ8MTXP01DRB41.19.48.E04.1.454.CMB.2.raw
  modified_base (554)..(554): a, c, t, g, unknown or other
  misc_feature (554)..(554): n is a, c, g, or t
  modified_base (570)..(570): a, c, t, g, unknown or other
  misc_feature (570)..(570): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggagcttggtccagccgtggggggtccctgagactctcctgtacaggctcgtgggttctcctttagtagttattggatgaactgggccccgcgaggccgtccggggggaaaggggccgggaggtggggtcggaccaaacgataaacgtgacaaagatggaaactagaaagaaaaaactgtagggggactacgtagtggaaaggggccgaattccaccatctaccagagaacaaccgtaataacttactgtttctgacaaatcgaacagcctaggggagaggcccgaggacaacggctagttagtattagttgtgcgtaagggcagggtgcgtagggacngttcgggacgttcggnggggcccgaaaggggcccacgggtccaaccggttccc

SEQ ID NO: 343619 - DNA, 743 bp, Homo sapiens
  misc_feature: GZ8MTXP01C2X3E.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctctttagtagttatggatgaacgtgggccccgcaggccgtccgggggaaggggcccggaggtgggtggaccaacgattaaagtgacaagatggaactagaaagaaaaacgtgtacggggtactacgtggtggaaacgggcccgtaattaccgaccattcctacccaaggtaacgaaaccgaaaccgttaaagtaaacctttaacgttagttttaccgttaggaacctaaaagttacgaaaccaacgtaccccgttagggggaaacggacggaaccccgggaaggggtaaaccgaaccggggtcgttaggttaagggttaattttaaggttgggttacgggacgggtaaaaggggccgttaagggttcgggccggttagggggaacttaagggttcgggaacggtttccgggacgggggaacccgaaacgggggaccccttacggggtaacccgaacccggtttccccg

SEQ ID NO: 343620 - DNA, 695 bp, Homo sapiens
  misc_feature: GZ8MTXP01BGKST.19.48.E04.1.454.CMB.2.raw
  modified_base (264)..(264): a, c, t, g, unknown or other
  misc_feature (264)..(264): n is a, c, g, or t
  modified_base (348)..(348): a, c, t, g, unknown or other
  misc_feature (348)..(348): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcgttggtccaggccgtggggggtccctgagactctcctgtacnggctctgggttctctttagtagttattggatgaacgtgggccccgcgaggcgtccgggggaaggggccggagtgggtgaccaanataatgacaagatagggaactaggaaagaaaaactgtagggggactcgtagtggaaacggggcccgtaattccacctagtctaccaagacgaacctaaaccggtaaagtaaactttacgtacgttttactagtacaaatagaaacacgaccctggggaacggacggacccggaaggaccgtaacggcgttaggttagttagtttaagttggttagggacggaaaggggcgttagggttcgggacggttagggggaacgttaaggttcggggaaccggttcgggtcggggggaacccgaaaacggggggaccccgttaaccggggttcccgttaacccgggttccccg

SEQ ID NO: 343621 - DNA, 729 bp, Homo sapiens
  misc_feature: GZ8MTXP01A2SLL.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggtcttggtccagccgtggggggtccctgagactctcctgtacaggctcgtgggttctcctttagagttattggatgaacgtgggccccgcgaggcgtccggggggaaggggccggaggtggggtcggccaaacataagtgacaagatgggaactgaaagaaaacgtgtagggggactcgtgtaaggaaggggtccgtattccgacctatcctacccagaagaaccgtaaaccgtaaggtaacttacttacggtttctagactaaagttacgaaacacgtaccctagggggaacgacgggacccggaacgggaaccgaccggtcgttacggttaggttaatttagttggtaggaccggggaaacgggggtcgttaaggggtcggggttccggtacgggggtaacgttaacgggttcggggttaacccgggtcgggttaccggggggaaccccgggaaagggggacccccgggttaaccgggggtaaccccttaacccggggtttcccccg

SEQ ID NO: 343622 - DNA, 569 bp, Homo sapiens
  misc_feature: GZ8MTXP01BB019.19.48.E04.1.454.CMB.2.raw
  modified_base (563)..(563): a, c, t, g, unknown or other
  misc_feature (563)..(563): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgagactctcctgtacaggctctgggttctctttagtagttattggatgaactgggcccgcaggcgtccgggggaaggggccggagtggggtcggccaacataatgacaagataggaactggaagaaaaactagtgggggactcgtggtgaaacggggcccattcgaccatctccaagacgaacaaccgtaagaacttactgtttactgacaaatgaacagcctggagagccgaggacacggctgtgtattgtcgtgcggaagggcaggtggcgtggggacagttgggacgtcgtggggccaaggggccacggtccnccgtcc

SEQ ID NO: 343623 - DNA, 723 bp, Homo sapiens
  misc_feature: GZ8MTXP01DWRAT.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcgacagacgactcaccatggaattggggctgagctgggttttcctcgttggtattttagaaggtgtccagtgtgaggtgcactggtggagtcgtgggggagcttggtccagccgtggggggtccctgagactctcctgtacaggctcgtgggttctcctttagtagttatggatgaacgtcgggccccgcgaggccgtccggggggaagggccggaggtgggtgaccaaacataaatgacaaagataggaactagaaagaaaaaactgtaggggactcgtggtggaaagggcccgaattaccgaaccctaatcctacccgaagaacgaaaccgtaaaaccgtaaagtaaacctttacgttacggttttacctaggtaaccaaaagttacgaaaaccagtaccccgtaggggaaacggaacggacccgggaaacgggacccgaaacccgggtcttaggttagtttaagtttaagtttggtggaaccgggtaaaagggggccttaaggggttggaccggttaggggaaccttagggttcgggttaaccggtccgggtagggggaacccaaacgggggacccaccgggttccgaaccccggttcccg

SEQ ID NO: 343624 - DNA, 662 bp, Homo sapiens
  misc_feature: GZ8MTXP01AFU2P.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctctttagtagttatggatgaacgtgggcccgcgaggcgtccgggggaaggggccggagtggggtggaccaacgataatggacaaagagtaggaactaggaaagaaaaactggtacgggggactacgtggtcggaaaggggccctattccaacctatcctaccgaagacgaacaaaccgtaagtaactttacgttagtttcctagacaaatacgaaacagaccgtagggaacgacggaccgagggaaccgacggtacgtggttagttaattgttaggtggacgggtaaagggggcgttagggtcggacggtacgggacggttacggttcgggttacggtcgggtcggggaaccgggaacgggaccggttaccggtaaccgttcccgtccg

SEQ ID NO: 343625 - DNA, 578 bp, Homo sapiens
  misc_feature: GZ8MTXP01AUGLW.19.48.E04.1.454.CMB.2.raw
  modified_base (479)..(479): a, c, t, g, unknown or other
  misc_feature (479)..(479): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtatttagaaggtgtccagtgtgaggtgcactggtggagtcgtgggggagcttggtccagccgtggggggtccctgagactctcctgtacaggctctgggttctctttagtagttattggatgacgtgggcccgcgaggcgtccgggggaagggccggagtgggtggccaacataatgacaagatggaactgaagaaaaactgtgggggactcgtaggtgaaggggccgtattcacctatctccagagaacaacgtaagaacttactagtttctagacaaatgaactagcctggagacgccgaggacacggntggtatattagtgtgcggaaggcgttaggtggcgtaggggacttggttcggacggttcggacgggggccgaaggggcccacgggtccaacccggtcccg

SEQ ID NO: 343626 - DNA, 584 bp, Homo sapiens
  misc_feature: GZ8MTXP01BILD0.19.48.E04.1.454.CMB.2.raw
  modified_base (467)..(467): a, c, t, g, unknown or other
  misc_feature (467)..(467): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagccgtggggggtccctgagactctcctgtacaggctctgggttctcctttagtagttattggatgaactgggccccgcaggccgtccgggggaaggggccgggaggtgggtggaccaacataatgtaaagatggaaactgaaacgaaaaactgtgggggactcgtaggtagaaggggccgattcacctatctaccagagaacaaccgtaaagtaacttatgtttactgacaaatgaacngcctgaggagccgaggacaggctgtgtattagtgtgacgagggtcagttggcgttgggactgttggcggttcgtaacgggggcaacgggacccacgggttccaaccggttcgtcccg

SEQ ID NO: 343627 - DNA, 784 bp, Homo sapiens
  misc_feature: GZ8MTXP01BASDL.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggaggcttggtccagccgtgggggtccctgagactctcctgtacaggctctgggttctcttagtagttatggatgacgtggcccgcaggcgtccggggagggccggagtgggtgaccaacataagtgacaaagagtaggaactgaaagtaaaaacgtagtagggggactacgttaggtaaggaaacgggccgtaacttaccgaacctacgtcccgtaacccgaaaggaaaccgaaaccgtaaaaccgggttaaacgtaaaccgttttaacgtttacggttttaccgttaacggaaacctaaaagttacgaaacgtaaggtaccccgttagggggaaacgggtaacgggaaccccgggaagggaaaccggtaccgggtacgttagggttaagttagttttaaacgggttgggttagggaaccggggtaaagggggtccgttaaggggtttcgggggccgttaaggggggaaccttaacggggttcggggaaccgggtttccgggtacggggggtaacccgaaaccgggggaccccggttaaccgggttcccgttaaccccggtttccccg

SEQ ID NO: 343628 - DNA, 647 bp, Homo sapiens
  misc_feature: GZ8MTXP01A0N0J.19.48.E04.1.454.CMB.2.raw
  modified_base (344)..(344): a, c, t, g, unknown or other
  misc_feature (344)..(344): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattgggctgagctgggttttcctcgttggtattttagaaggtgtccagtgtgaggtgcaccgtggtggagtcgtgggggagcttggtccagccgtgggggtccctgagactctcctgtacaggctctgggttctcctttagtagttatgggatgaacgtgggccccgcaggcgtccgggggaagggccggagtgggtggccaaanataatgacaagtatagggaactagaaagaaaaactgtagggggactcgtagtggaaacgggccaagttcaccgtatctaccgagacgaacaaccgtaagaacttacttaggtttctagacgaaattgaaacacgaccgtagggaacgagggaccgaagggacctaacgggtctaggtattagttagttggtggaccgggaaagggcgttaagggtcggacgttagggggaacttaggttcgggacggttcgtcgggggaacccgtaaaggggccccgaacggggtcccttaacccggttcccg

SEQ ID NO: 343629 - DNA, 551 bp, Homo sapiens
  misc_feature: GZ8MTXP01CTNHE.19.48.E04.1.454.CMB.2.raw
  modified_base (262)..(262): a, c, t, g, unknown or other
  misc_feature (262)..(262): n is a, c, g, or t
  modified_base (345)..(345): a, c, t, g, unknown or other
  misc_feature (345)..(345): n is a, c, g, or t
  modified_base (412)..(412): a, c, t, g, unknown or other
  misc_feature (412)..(412): n is a, c, g, or t
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (495)..(496): a, c, t, g, unknown or other
  misc_feature (495)..(496): n is a, c, g, or t
  modified_base (501)..(501): a, c, t, g, unknown or other
  misc_feature (501)..(501): n is a, c, g, or t
  modified_base (506)..(507): a, c, t, g, unknown or other
  misc_feature (506)..(507): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacnggctctgggttctctttagagttatggatgaactgggccccgcaggcgtccgggggaagggccggagtgggtgccaacataangacaagatggaactgaagaaaaactgtaggggactcgtggtgaagggcccagttcacatctccaganacaacgtaagaacttatgtttcagacaaatgaaacngacctaggagagccgaggacacggtntgtntattntgtgnggaaggnnggtgngtggnngcgggacgtcggcgggaaccgaacgggaccgacggtccgccgtc

SEQ ID NO: 343630 - DNA, 811 bp, Homo sapiens
  misc_feature: GZ8MTXP01AUFFA.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctctttagtagttattggatgaacgtgggccccgcgaggccgtccgggggaagggccggaggtgggtggaccaacataagtgacaaagataggaactaggaaagtaaaaacgtagtacgggggaaccttacgtagggttaacgggaaacgggggtcccgtaagtttacccaaccccgtaacgttacccgttaaccccgaaggtaaacggtaaaccccgtaaaaccccgggtttaaaacggtaaaaccctttttaacgtttacgggtttttacctacgggtaacctaaaaacgttcgaaaacccgtaggtaccccgtagggggaaacgggaacgggaccccgggaaagggaccgaaccggggtcttagggttagtttaatttaggtttaggtcgggaccgggtaaaggggccgttaaaggggttcggggaccgttagggggaaccttagggttcggggttacccgggtttcgggtacggggggaaccccgtaaaacggggggtaccccgaaccgggggttccccgaacccggtttccccg

SEQ ID NO: 343631 - DNA, 642 bp, Homo sapiens
  misc_feature: GZ8MTXP01EHA5T.19.48.E04.1.454.CMB.2.raw
  modified_base (339)..(339): a, c, t, g, unknown or other
  misc_feature (339)..(339): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcttggtccagccgtgggggtccctgagactctcctgtacaggctcgtggttctctttagagttatggatgaactgggcccgcaggcgtccgggggaagggccggagtgggtggccaanataatgacaagataggaactagaagaaaaactgtggggactcgtaggtggaaagggcccgtattccaaccatcctaccaagaacgaaccaaacgtaagtaaaccttacttagtttcctagacaaagtgaaacagaccctagggacgacggaccgagggacgacggcttaggttagtatttagttggtcgaccgggtaagggcgttaagggtcggttacggtaggggaacttaggttcgggaccgtcgggtcgggggaacccgtaacggggacccgttaccgggtcccgttaacccggttcccg

SEQ ID NO: 343632 - DNA, 559 bp, Homo sapiens
  misc_feature: GZ8MTXP01AQQOP.19.48.E04.1.454.CMB.2.raw
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (515)..(515): a, c, t, g, unknown or other
  misc_feature (515)..(515): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcttagtagttatggatgaactgggcccgcaggcgtccgggggaagggccggagtgggtgccaacataatgacaagataggaactagaagaaaactgtggggactcgtgtggaacgggccgattccgactatctaccagacgaacaaaccgtaagtaacttactagtttcagacaaatgaacagcctgggagagcgagacncggntgtntattgtgtgnggaaggcaggtcgcgtgggacngttcggacgtcgcggggaaccgaagggcccacggtccgccgtcc

SEQ ID NO: 343633 - DNA, 653 bp, Homo sapiens
  misc_feature: GZ8MTXP01ES4AN.19.48.E04.1.454.CMB.2.raw
  modified_base (331)..(331): a, c, t, g, unknown or other
  misc_feature (331)..(331): n is a, c, g, or t
  modified_base (516)..(516): a, c, t, g, unknown or other
  misc_feature (516)..(516): n is a, c, g, or t
  modified_base (563)..(563): a, c, t, g, unknown or other
  misc_feature (563)..(563): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacgtggtggagtcgtgggggagcttggtccaggccgtgggggtccctgagactctcctgtacaggctcgtgggttctcttagtagttatggatgactcgggccccgcgaggcgtccggggggaagggccgggnggtgggtcgccaaacataatggacaaagagtaggaactgaaagaaaaactgtaggggaccttcgtggtggaaacggggtcctagttccacctatcctaccaagacgaacaaaccgtaagaactttacttcgtttactagactaaatcgaaacagcccgtagggacggaacggaccggaggaaccncgggtcgttggtagttaatttagttaggtcggacgggaaacggggtnttaagggtcggagtggggaacttggttcgggacggttcgggcgggggaacccgaaagggggacccgaccgggttccgaaccccggttccg

SEQ ID NO: 343634 - DNA, 791 bp, Homo sapiens
  misc_feature: GZ8MTXP01BMFIK.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttatggatgaacgtgggccccgcgaggcgtccgggggaagggccggagtgggtggccaacataatgacaaagatggaactaggaaagaaaaactagtagggggacttcgtggtggaaacggggcccgtaattccgaaccctaacgttcctacccaaggaacgaaacctaaaacccggttaaacggtaaaccttttaacgtttacggtttttacctacggtaacctaaaagttacggaaaaccaggtaccccgttagggggaaacggaaccgggaccccgggaaacggggaacccgaaccggggtccgtttaggtttagggtttaacttttaaggtttgggttacgggtaaccggggtaaagggggccgttagggggtttacggggaccggttaggggggaaccttagggttcgggggttaaccgggtttccggggtacggggggaaccccgtaaaacggggggtacccccgacgggggtttaacccccgaaccccgggtttccccg

SEQ ID NO: 343635 - DNA, 779 bp, Homo sapiens
  misc_feature: GZ8MTXP01DHS2Q.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccatggcctttccacttggtgatcagcactgagcacagacgactcaccatggaattggggctgagctgggttttcctcgttggtatttagaaggtgtccagtgtgaggtgcacctggtggagtcgtgggggaggcttggtccagccgtggggggtccctgagactctcctgtacnggctctgggttctcttagtagttattggatgaacgtcgggcccgccagggcgtccgggggaagggggccggaggtggggtggccaacataatgacaagataggaacctggaaagtaaaacgtagtgggggaaccttcgtggtagggaacgggtcccgtattccacctatccctacccaagaacgaaccgaaacccggttaaagtaaaccctttaacgttgttttacctacggtaacaaaagttcggaaaccacggtacccgggttaaggaacgggtaaccgggacccccgggtaaaggggaacccgtaaccggggtccgtttaggtttaggtttaagttttaacggtttgggtagggtaaccggggtaaagggggttcccggtaaagggttcgggggtacggttacgggggaaaccgttgggtttaccgggggaaccgggtttaccgggttaacggggggggtaaccccgaaaacggggggttaccccgtaaccgggggttcccgttaacccccgggg

SEQ ID NO: 343636 - DNA, 700 bp, Homo sapiens
  misc_feature: GZ8MTXP01BX1BG.19.48.E04.1.454.CMB.2.raw
  modified_base (322)..(322): a, c, t, g, unknown or other
  misc_feature (322)..(322): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggagcttggtccagccgtgggggtccctgagactctctgtacagctcgtggttctctttagtagttatggatgacgtggcccgcgaggcgtccgggggagggccggngtgggtgcaacataatgacaaagagtaggaactaggaaagtaaaaacgtagtagggggactacgtggtaagggaacggggccgtaattccacctatacctaccgaagaacgtaaccaaaccggttaaagtaaacctttacgttacggttttctagactaaaagttagaaaccgagacccgttagggggaacggacggaccggaaacggaccgaacgggtcttaggttagtttaatttaggttggtacgggcgggtaaacggggcgaagggtcggggttcggtagggggtaaccttagggttcggggaccggttcggggtaccggggggaacccgtaaacggggggacccgaccggggttcccgttaacccggttcccg

SEQ ID NO: 343637 - DNA, 561 bp, Homo sapiens
  misc_feature: GZ8MTXP01C9WOP.19.48.E04.1.454.CMB.2.raw
  modified_base (435)..(435): a, c, t, g, unknown or other
  misc_feature (435)..(435): n is a, c, g, or t
tcagtactctcgtgcacgaccggtgctcgatttagagagcgtcacagagagaaggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttattggatgaactgggccccgcaggcgtccgggggaagggccggagtgggtgccaacataatgacaagatggaactgaagaaaaactgtggggactcgtgtgagggcccgattcacatctcagagacaaccgtaagaacttactgtttcngacaaatgaacagcctgggagaggaccgaggacacggctagtagtattatgtgcgaaggggcaggtggctaggggacagttcgggacgtcgtgggggccaaggggcccacggtccgaaccggttcc

SEQ ID NO: 343638 - DNA, 803 bp, Homo sapiens
  misc_feature: GZ8MTXP01CFX96.19.48.E04.1.454.CMB.2.raw
  modified_base (267)..(267): a, c, t, g, unknown or other
  misc_feature (267)..(267): n is a, c, g, or t
  modified_base (352)..(352): a, c, t, g, unknown or other
  misc_feature (352)..(352): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgttgggttttcctcggtttggttattttagaaggtgtccagtgtgaggtgcacctggtggagtcgtgggggagcttggtccaggccgtgggggtccctgagactctcctgtacgngctcgtgggttcttcctttagtgttattggatgaacgtcgggccccgcgaggcgtccgggggaagggccggaggtgggtgccaanataatgacaagataggaactagaaagtaaaacgtaggtaggggacctcgtaggtggaaacgggtccgtaacgtttccaaccgtaacttccgtaccccgaaaggaacgtaaaaccccgtaaaaccggttaaaacgtaaacctttaacgtttggtttttaacccagggtaacctaaaagtacgaaaaccgtacggtaccccgttagggggaacggaaacgggccccgggaaagggaaccccgtacggggtacctttgggttaacgtttaagttttaaggttagggttacggccgggggtaaaagggggtcccgttaaagggggttcgggcccgggttaagggggtaccgaaggggtttccggggttaaccggggttcccggggtaaccggggggaacccggaaacgggggtacccccgttaaccggggtccccgttaaccccgggtttccccg

SEQ ID NO: 343639 - DNA, 600 bp, Homo sapiens
  misc_feature: GZ8MTXP01DAKUH.19.48.E04.1.454.CMB.2.raw
  modified_base (350)..(350): a, c, t, g, unknown or other
  misc_feature (350)..(350): n is a, c, g, or t
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtattttagaggtgtcagtgtgaggtgcacgtggtggagtcgtgggggagcttggtccaggccgtggggggtccctgagactctcctgtacaggctcgtgggttctcctttagtagttattggatgaacgtgggccccgcgaggcgtcgggggaagggccggaggtgggtggaccaacataangacaagatggaactagaaagaaaaactgtggggactcgtggtggaaacgggccgattccgaaccatcctaccaagagaaactaaaccgtaagtaaacttacttgtttcctagacaaatagaacagccgtaggaacgaggacccgaggacacggntgttagtattagttgngtcggaagggcgaggtggcgtaggggacagttgggacgtgtacgggggccgaacggggaccacgggttcaacccgttccg

SEQ ID NO: 343640 - DNA, 576 bp, Homo sapiens
  misc_feature: GZ8MTXP01EL9M4.19.48.E04.1.454.CMB.2.raw
  modified_base (348)..(348): a, c, t, g, unknown or other
  misc_feature (348)..(348): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtggggggagcttggtccagccgtggggggtccctgagactctcctgtacaggctcgtgggttctctttagagttatggatgaacgtgggccccgcaggcgtccgggggaagggccggagtgggtgcaagataagngacaagatggaactagaaagaaaaactgtgggggaactcgtagtggaaagggcccgattcaccatctcagagacaaacgaanaacttactgtttcngacaaatgaaacagcctagggagacgccgaaggacacggtntagtntatgtgcgnggaaggnaggtggngtagggacttaggttcggacggtcggtacggggaaccgaacgggaccgacggtccgcccgtcc

SEQ ID NO: 343641 - DNA, 623 bp, Homo sapiens
  misc_feature: GZ8MTXP01BMKYE.19.48.E04.1.454.CMB.2.raw
  modified_base (353)..(353): a, c, t, g, unknown or other
  misc_feature (353)..(353): n is a, c, g, or t
  modified_base (552)..(552): a, c, t, g, unknown or other
  misc_feature (552)..(552): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacgtggtggaggtcgtgggggagcgttggtccagccgtggggggtccctgagactctcctgtacaggctcgtggttctcctttagtagttatggatgaacgtcggccccgcgaggccgtcgggggaaggggccggaggtgggtgaccaacataangacaagataggaactaggaaagaaaaactggtaggggactagtggtgggaaacgggccgtaattccgaacctagtcctaccagaacgaacaaaccgtaaagtaacttacttagttctagacaaatagacagcctagggaagacgaccgaaggacgacggtctgtagttagttagtgtgaggaagggcgttagggtcggnggtagggacttaaggttcgggacggtcggacggggaaccgaacggggcccgacggtccgaacccggttccc

SEQ ID NO: 343642 - DNA, 553 bp, Homo sapiens
  misc_feature: GZ8MTXP01BK2FT.19.48.E04.1.454.CMB.2.raw
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (488)..(488): a, c, t, g, unknown or other
  misc_feature (488)..(488): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgagactctctgtacaggctctgggttctcctttagtagttatggatgaactgggcccgcaggcgtcgggggagggccggagtgggtgcanatatgcagntggactgagaaaactgnggggactctgtgagggcccattcacatctcagagacaacgtaanacttatgtttcngacaaatnaacagcctggagagccggaggacacggctggtagtattagtggtgcggaagggcaggtggngtggggacagttgggaccgtcgggtggggaaccgaacgggggacccacggtccgaacccgttccc

SEQ ID NO: 343643 - DNA, 757 bp, Homo sapiens
  misc_feature: GZ8MTXP01EIIQ6.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacgtggtggagtcgtgggggagcttggtccagccgtgggggtccctgagactctcctgtacaggctcgtgggttctcctttagtagttatggatgacgtcgggccccgccgaggccgtaccgggggaaggggcccgggaggtggggtcggaccaaacataatgacaagagtaggaaactaggaaagtaaaaaactgtagggggactacgtaggtaacggaaagggccgtattcccgaacctactcctaccgaagaacgaaaccgtaaacccggttaaaagtaaaccctttacgtttacggttttaccgtaggtaaacctaaaagttacgaaaaccgtacgtaccccgttaaggggaacggaacggaccgggaaagggaacccggaacggtccgttaggtttaggtttaaatttaggttttacggtagggaaccgggtaaagggggtccttaaggggttcgggcgggttagggaacttaggttcgggggacgggttccgggtacggggggaacccgaaacgggggacccgttaaccgggttccgttaaccccgggttcccg

SEQ ID NO: 343644 - DNA, 768 bp, Homo sapiens
  misc_feature: GZ8MTXP01B9PR3.19.48.E04.1.454.CMB.2.raw
  modified_base (361)..(361): a, c, t, g, unknown or other
  misc_feature (361)..(361): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggtcttggtccagccggtggggggtccctgagactctcctgtacaggcttcgtgggttcttcctttagtagttagttggatgaacgtcgggccccgcgagggccgtccggggggaaggggccgggaggtgggtcgaccaanataagtgacaagagtggaactagaaagaaaactaggtagggactcgtaggtggaacgggcctagttcaccctatacctacccagaacgaaccgtaaaccggttaaagtaaacctttacgttaggttttacctagaactaaagttacgaaaccgaggtacccgtagggggaacggaacgggacccggaaacgggaccgtaacccgggtacgtttaggtttagtttaacgttttagggtttaggtacggggtaacgggtaaaaccggggggtgttaaacgggggtcggggttacccgtaaggggggtaaccttaagggggttccggggttaaaccgggttccgggacggggggtaacccggaaacgggggtccccgaccggggtttaaccccgcccggtttaacccccg

SEQ ID NO: 343645 - DNA, 587 bp, Homo sapiens
  misc_feature: GZ8MTXP01AMCD0.19.48.E04.1.454.CMB.2.raw
  modified_base (408)..(408): a, c, t, g, unknown or other
  misc_feature (408)..(408): n is a, c, g, or t
  modified_base (552)..(552): a, c, t, g, unknown or other
  misc_feature (552)..(552): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctcctttagagttatggatgaactgggccccgcaggctccgggggaagggccggagtgggtgccaacataatgcaagatggaactgaagaaaactagtggggactctgtggaagggccgattcaccatctccaganacaacgtaagacttatgtttcagacaaatcgaaacagtccctaggggaacggacggccggaagggaccacgggtcttaggtagttatttagttgtcggcggaaggggcagggtcggcgtaggggacaggttcgggacgttcggnggggcccgaaagggcccacgggtcaacccggttcc

SEQ ID NO: 343646 - DNA, 647 bp, Homo sapiens
  misc_feature: GZ8MTXP01B9KE1.19.48.E04.1.454.CMB.2.raw
  modified_base (346)..(346): a, c, t, g, unknown or other
  misc_feature (346)..(346): n is a, c, g, or t
  modified_base (394)..(394): a, c, t, g, unknown or other
  misc_feature (394)..(394): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtcagtgtgaggtgcacctggtggagtcgtgggggagcttggtccagccgtgggggtccctgagactctcctgtacaggctcgtgggttctcctttagagttattggatgaacgtcgggccccgcaggcgtccggggggaagggccggaggtgggtcggaccaanataatgacaagatggaactaggaagaaaactagtgggggactcgtggnggaagggcccgtattccaccatcctacccgagacgaaccaaaccggtaagaacctttacttaggtttactaggtaaccaaagttcgaaacagccctagggggacgacggaccggagggaccgtacggcttggtagtatttagtggtggcggaaagggcgagggtgggcgtagggggacttaggttcggggaccgttgggtacgggggaacccgtaaacgggggcccttaccggggtccgaaccccggttcccg

SEQ ID NO: 343647 - DNA, 732 bp, Homo sapiens
  misc_feature: GZ8MTXP01AOIHA.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctctgtacaggctcgtgggttctcctttagtagttattggatgaacgtcgggccccgccgagggccgtcccggggggaaggggccgggaggtgggggtggaccaaacataaagtgacaaagataggaaactaggaaacgaaaaacgtagtagggggacttacgtaggtcgggaaagggtcccgtaattaccgacctacgtcctacccgaagaacgaaccaaaccggggggttaaactaaaccgtttacgttacgttttactaggaacctaaagttacgaaacgtacgtaccgtaggggaacggacggacccgggaagggaccgaacgggtccgttaggttagtttaagtttagtttaggtcggacggggtaacggggcgttagggttcgggaccggttaggggaaccgttaggttcgggttacggtcgggtcgggggaacccgaacggggaccccgaccggtccgttaaccccgttccccg

SEQ ID NO: 343648 - DNA, 704 bp, Homo sapiens
  misc_feature: GZ8MTXP01CFF0L.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctctgtacnggctctgggttctccttagtagttatggatgaactcgggccccgcgaggccgtccggggggaagggccggaggtcggggtggaccaacgataaagtgacaaagagtggaaactggaaagaaaacgtgtacgggggactcgtggtggaaaggggcccagttccacctatacctacccaagaacgtaaccaaaccggttaaagtaaacctttacgttacgttttacacggtaacctaaaagttcgaaaaccgcgtacccgttaaggggaacggaacggaccccggaagggaaccgaacccgggtgttggttagttaagtttagttggtacggaccgggaaaggggcttagggtgggccgttagggggacttaggttcggggttaacggttcgggtcgggggaacccgaacgggggtacccaccgggtccgttaaccccggttcccg

SEQ ID NO: 343649 - DNA, 647 bp, Homo sapiens
  misc_feature: GZ8MTXP01AXJYC.19.48.E04.1.454.CMB.2.raw
  modified_base (509)..(509): a, c, t, g, unknown or other
  misc_feature (509)..(509): n is a, c, g, or t
  modified_base (612)..(612): a, c, t, g, unknown or other
  misc_feature (612)..(612): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggaggctttggtccaggccgtggggggtccctgagactctcctgtacaggctcgtgggttctctttagtagttatggatgaacgtcggccccgcgaggcgtccgggggagggccggaggtgggtcggaccaacataatgacaagataggaactagaaagtaaaacgtaggtacggggattacgtagggtggaaacggggtaccgacttaccacctacgtcctaccgaagaacgaaccgtaaaccggtaaagtaaccttactttaggtttactacgaactaaatcgaaaacncgaccgtaggggaacgaacggccggaagggacgcggtcgttagtagttatttagtgtggacggaaggcttggtcggcgtagggacttaggttcggacgtcggnggggtaaccgaagggacccgacggtccaaccgtcc

SEQ ID NO: 343650 - DNA, 745 bp, Homo sapiens
  misc_feature: GZ8MTXP01BSMFV.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacnggctcgtgggttctctttagtagttattggatgaacgtcgggccccgcgagggccgtccggggggaaggggccggaggtggggtcggaccaagataagtgacgaaaggagtaggaactaggaaagaaaaacgtgtagggggactacgtggtaaggaaacgggccgtaattccaacctatcctacccgaaggaacgaaaccgtaaaccggttaaacgtaaacctttacgttacgttttacgtagtactaaaagtcgaaactacgtacccgtaggggaacggaacgggacccggaagggaccgtacgggtcttaggttaggtttaatttaaggtttggtacgggacggggtaaacggggtcgttaaggggttcgggacgggtacgggggtacgttaacgggttcggggttaacccgggttcggggtacgggggaaccccggtaaacgggggaccccgttacggggttccccgaacccggtttccccg

SEQ ID NO: 343651 - DNA, 657 bp, Homo sapiens
  misc_feature: GZ8MTXP01AKOIB.19.48.E04.1.454.CMB.2.raw
  modified_base (540)..(540): a, c, t, g, unknown or other
  misc_feature (540)..(540): n is a, c, g, or t
  modified_base (588)..(588): a, c, t, g, unknown or other
  misc_feature (588)..(588): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcttggtccagccgtggggggtccctgagactctcctgtacaggctctgggttctctttagtagttattggatgaacgtcgggccccgcgagggccgtccggggggaaggggccgggaggtggggtggaccaacataaatgacaaagataggaactaggaaacgaaaaacgtagtgggggacttcgtaggtggaaacggggccgtacttaccgacctactacctacccgaaggtaacgaaaccgtaaaccggtaaacgtaaactttacgttgtttactagaactaaattcgaaacagccctgggaagagaccggaggacncggtcgtgtagttattagttggtgacgggaagggtcgaaggtcggggngtagggaacttggttcgggacgtcgggtcggggaacccgaacgggacccgttacggtcccgttcccgtc

SEQ ID NO: 343652 - DNA, 585 bp, Homo sapiens
  misc_feature: GZ8MTXP01EUDD5.19.48.E04.1.454.CMB.2.raw
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (525)..(525): a, c, t, g, unknown or other
  misc_feature (525)..(525): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctggggggtccctgagactctcctgtacaggctctgggttctcttagattatggatgaactggcccncaggctccggggaaggccgagtgggngccaaanataanganaagatagaactagaaagaaaatgacgggactacgtagtaaggaacgggccgtattaccaacctactctaccaagaacgaacctaaacgtaaataacttacgttagttactagacaaatagaacacgacgaggagacgaccgacggacgacgcgtagtagtattagttagtgaggaaggagaggtggngtggacgagttggacggtcggtcgggaacggaacgggaccgaccgtaaccgaaccgtccg

SEQ ID NO: 343653 - DNA, 896 bp, Homo sapiens
  misc_feature: GZ8MTXP01AMDZR.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggagtcttggtccagccgtggggggtccctgagctctcctgtacngctcgtgggttctctttagtagttatggatgaacgtgggccccgcaggccgtccgggggaagggccggagtgggtcgaccaacataagtgcaaagagtaggaactaggaaagtaaaaacgtaggtagggggaaccttcgttagggtaacggaaacgggggtccccgtaatttacccgaaccctagttacccgtaaccccgaagggaaacgtaaaccccgtaaaacccggggttaaaggtaaaaccctttttccggttaacggtttttaccttacgggaaaccttaaaaacggttacgaaaacccgtagggtaccccgttaagggggaacgggtaaacggggtaccccgggtaaacgggggaacccggaaccgggggttcccgtttaggggtttaacggttttaaacgtttttaaaggtttggggttaacccggggaacccgggggtaaaagggggtcccgttaaacgggggtttagggccggggtttaaacggggggaaaccccttaagggggtttccgggggttaaaccccggggtttccggggtaccggggggggaaaccccggaaaacccggggggtaccccccggttaacgggggtttaaccccccgaaaccccggggtttttcccccg

SEQ ID NO: 343654 - DNA, 737 bp, Homo sapiens
  misc_feature: GZ8MTXP01BGBD0.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctgttggtattttagaaggtgtccagtgtgaggtgcacgtggtggagtcgtgggggagtcttggtccagccggtgggggtccctgagactctctgtacngctcgtggttctcgtttagtagttatggatggacgtcgggccccgcgagggccggtacccgggggaaggggccggtaggtgggggtacggacccaaacgagtaagtgacaaaggagtaggtaactaaggaaagaaaaaacgtggtacgggggtacttacgtggtaagggaacggggtaccctacgttaccaaccctactcctaccaaggaacgtaaacccgaaaaccgttaaagtaaacctttaccgttagttttaccgtacgtaacctaaaagtcgaaaccgagtaccccgttaggggaacggtaaccgggaaccccgggaaggaaaccgccgggtcgttaggttagtttaagttagttcggtaggacgggaaagggtcgttaggttcgggcggttagggaaccttaggttcgggaccggttgggaccggggaaccgaaacggggcccttaaccgggtcccgaacccggttcccg

SEQ ID NO: 343655 - DNA, 747 bp, Homo sapiens
  misc_feature: GZ8MTXP01AQ02U.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaagttggggctgagcttgggttttcctcgttggtatttagaaggtgtccagtgtgaggtgcaccgtggtggagtcgtgggggagtcgttggtccaggccggtgggggggtcccctggacgtacctcctcctgtacaggtctcgttgggttcttcctttagtagttattggatgaacgtgggccccgcgaggcgtccgggggaaggggcccggagtggggtcgaccaacataatgacaaagagttaggaaactgaaagaaaaacgtgtcgggggaactcgtaggtggaaacgggtccgatttaccgacctatcctaccgaagaagaaaccaaacccgggttaaataaccttacttcgtttaccagaactaaaagttcgaaaccagaccccgtaggggaaacggtacggaccggaacgggtaccgaaccgggtcgttaggttagtttaagtttaagttttccgggtagggaacggggaaccggggtcgttaagggtcgggttaccggttagggggaccaagggttccggggttaacccggttcggggtacgggggtaaccccgaaacgggggccccggttaacccggttcccgttaacccgggttcccccg

SEQ ID NO: 343656 - DNA, 599 bp, Homo sapiens
  misc_feature: GZ8MTXP01AR37H.19.48.E04.1.454.CMB.2.raw
  modified_base (514)..(514): a, c, t, g, unknown or other
  misc_feature (514)..(514): n is a, c, g, or t
  modified_base (525)..(525): a, c, t, g, unknown or other
  misc_feature (525)..(525): n is a, c, g, or t
  modified_base (545)..(545): a, c, t, g, unknown or other
  misc_feature (545)..(545): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaggtgtccagtgtgaggtgcaccgtggtggagtcgtgggggagcttggtccaggccgtggggggtccctgagactctcctgtacaggctcgtgggttctcctttagtagttatggatgaacgtgggcccgcaggctccgggggaaggggccggagtgggtggccaacataatgacaagatggaactgaaagaaaaactagtagggggactcgtaggtggaaaggggcccgaattccgaaccatctccaagagaacaaaccgtaaagtaacttacgttcgtttctgacaaatgaaacagcctaggagagaccgaggacacggctgtagtattaatggtncggtaaagggngaggtggcgtaggacttagnggacggtcgggacggggaaccgaacggggaccgttacggtccgttaaccgtccg

SEQ ID NO: 343657 - DNA, 777 bp, Homo sapiens
  misc_feature: GZ8MTXP01AZF2A.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagtcttggtccagccggtggggggtccctgagactctctgtacngctcgtggttctcttagtattatgatgacgtcggcccgcgaggcgtccgggggaggggcggaggtgggtcgacaacgataagtgacaagagtaggaactaggaaagaaaaacgtggtaggggtactcgtaggtgggaaacgggccgtacttaccgacctacgtcctacccgaaggtaacgaaaccgtaaaacccggttaaacgtaaaccgtttaacgtttacggttttacctaacggtaacctaaaattacggaaaaccgacggtacccgtagggggaacggaacggacccgggaacgggaaccgtaccgggcgttaggtttagttaagtttaggtttagggttacgggacggggtaacggggtacggacgggttacgggttcgggtacggggtaaccgttagggttccgggggttaccgggtttccggggtaccggggggaaacccgggaaaacccgggggtaccccggttaaccccgggggtttaacccaacccccggggttttaacccccg

SEQ ID NO: 343658 - DNA, 768 bp, Homo sapiens
  misc_feature: GZ8MTXP01A7HTC.19.48.E04.1.454.CMB.2.raw
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggtttcctcgttggtatttagaggtgtccagtgtgaggtgcacgtggtggagtcgtgggggagcttggtccagccggtggggggtcctgagactctcctgtacnggcttcgtgggttctctttagtagttagtggatgaacgtcgggtccgcgagggccgtccggggggaagggccggagtgggtgaccaanatatgacaagagtggaactaggaaagtaaaaacgtggtacgggggtacttacgtagggtaacgggaaacggggtcccgtaacgtttaccaacctacgttcctaacccgaaggaacgaaaccctaaacccggttaaagtaaacctttacgttacgtttaccgtaggaacctaaaagttacgaaacgtacgtacccgtaagggggaacggaaccggaaccggaacgggaaccgtaacccgggtcgtttaggtttaacggtttaagttttaaacggttggtaacgggttaccgggggaaaggggtccgaaagggggttcggttacgggtacggggtacttaacgggttcggggttaacggttccggggtacggggaaccggaaacggggacccgttaaccgggtcccgttaacccggttccccg

SEQ ID NO: 343659 - DNA, 796 bp, Homo sapiens
  misc_feature: GZ8MTXP01AFG7O.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtatttagaaggtgtccagtgtgaggtgcaccgtggtggagtcgtgggggaggtcttggtccaggccgtggggggtccctgagactctcctgtacnggtctcgtgggttcttctttagtagttagtggatgaacgtcgggccccgcgaggccggtaccggggggaacggggtccgggaggtgggggtacggacccaaacgtaagttaaagtaggtaaagtaagtaggaaacgtaggaaaacgtaaaaactggtacgggggtactcgtaaggtagggaacgggtccgtaacgttaccaacctagttccgtaccgaaaggaacgaaaccctaaaccggttaaagtaaacctttacgttacgtttaccgtaagtaactaaaagtacgaaacgtacggtacccgttaagggaacggggaaccgggacccggggtaagggaacccggtaacgggtcgttggttaaggtttactttaagttgggtacgggaaccgggtaaagggggccgtaagggggttcggggtccggttacgggggaagtacggttacgggggttaccggttccggggaacgggggaccccgtaaacgggggaccccgaccgggttaccgtaaccccgttcccgttaaccccg

SEQ ID NO: 343660 - DNA, 754 bp, Homo sapiens
  misc_feature: GZ8MTXP01D4X00.19.48.E04.1.454.CMB.2.raw
  modified_base (351)..(351): a, c, t, g, unknown or other
  misc_feature (351)..(351): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtggggggaggtcgttggtccaggccgtggggggtccctgagctctctgtacaggctcgtgggttcttctttagtagttattggatgacgtcgggccccgcgaggccgtcgggggaaggggccggaggtgggcgacaanataatgacaagagtaggaaactaggaaagtaaaaacgtaggtacgggggactacgtaggtgggaaacggggtcccgtaagtttacccgaacctactacccgtaacccgaaaggaaacggaaacccgtaaaacccggttaaaacgtaaaccttttaaaccgtttaactttttacccgtaaggtaaaccctaaaaagttacgaaaaccgtaacggtaccccgttaagggggaaacggaccgggaacccggaacggggaaccgaaccgggtcgttaggttagttaatttaggttacggtggacgggaaaggggtcgaagggtcgggcgtaggggaacttagggttcgggaacggtgggtcggggaaccggaacggggacccgttacggtccgttaacccggttccc

SEQ ID NO: 343661 - DNA, 618 bp, Homo sapiens
  misc_feature: GZ8MTXP01EQMNU.19.48.E04.1.454.CMB.2.raw
  modified_base (265)..(265): a, c, t, g, unknown or other
  misc_feature (265)..(265): n is a, c, g, or t
  modified_base (342)..(342): a, c, t, g, unknown or other
  misc_feature (342)..(342): n is a, c, g, or t
  modified_base (485)..(485): a, c, t, g, unknown or other
  misc_feature (485)..(485): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctctgtacaggctntgggttctctttagtagttatggatgaacgtgggaccccgcaggcgtccgggggaagggccggagtgggtgaccaanataatgacaaagatggaactagaaagaaaaaactgtagggggacctagtagtggaaacggggtcccaatttcccaacctatctacccgaagaacgaacctaaaccggtaaataaacttacttagtttcctagacaaaagttanaacacgacgtaggacgacgacggacgacgacgcgtgtagtattagtgtggnggaaggacgaggtggnggtagggacgaggttcggacggtcggtcgggaaccggaacgggaccggaccggtccgttccgtccg

SEQ ID NO: 343662 - DNA, 695 bp, Homo sapiens
  misc_feature: GZ8MTXP01BC4JY.19.48.E04.1.454.CMB.2.raw
  modified_base (377)..(377): a, c, t, g, unknown or other
  misc_feature (377)..(377): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtgggttctcctttagagttatggatgaacgtgggccccgcaggccgtccgggggaagggccggaggtgggtggacccaacataatgcaagatggaactgaagaaaactgngggggactcgtgtgaagggccgtattccaacctatctacccgagtacgaaccaaaccggtaagtaaacctttacgttacgttttacctaggacctaaaagttcgaaaccacgtaccctagggggaaacgacgggaccccggaagggaaccgtaacccggggttgttaggttacgttaactttaggttcgggtacgggacgggtaaacgggtcgttaagggtcgggaccgtaggggacgttaggttcggggttaccggtcggggtaccgggggaacccgtaaacggggacccgttaccgggtcccgttaacccggtccc

SEQ ID NO: 343663 - DNA, 852 bp, Homo sapiens
  misc_feature: GZ8MTXP01ELTY8.19.48.E04.1.454.CMB.2.raw
  modified_base (258)..(258): a, c, t, g, unknown or other
  misc_feature (258)..(258): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctgttgtattttagaggtgtccagtgtgaggtgcacgtggtggagtcgtgggggagcttggtccaggccgtgggggtccctgacgactctcctgtacnggctcgtgggttctcctttagtagttatggatgacgtcgggccccgcgaggccgtaccggggggaagggccggaggtgggtacggcccaaacgtattaaagtcggacaaaggtaagtagggaaaccttaggaaaacgtaaaaaaacgtggtacgggggaacttcgtaggtaacgggaaacgggggtccctaaatttccaacccgtattcctacccgaaggaacgaaccgtaaaacccgtaaaggtaaacctttactttacgggtttttacctaggaacctaaaacgttacgaaaacctacggtaccccgttagggggaaaccggtaacggggacccccgggaaagggggaaacccgtaacccggggtccgttttacggggtttaagttttaacggttttaaagttttcgggggtagggtaaccgggggaaaagggggttcccttaaagggggttcggggttacccgggttagggggaaacccttaggggttcgggggttaaacccgggtttccgggggtacggggggaacccccggaaaacggggggtacccccgttaaccgggggttccccttaacccccggggtttcccccg

SEQ ID NO: 343664 - DNA, 567 bp, Homo sapiens
  misc_feature: GZ8MTXP01D865F.19.48.E04.1.454.CMB.2.raw
  modified_base (368)..(368): a, c, t, g, unknown or other
  misc_feature (368)..(368): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctggggggtccctgagactctcctgtacaggctctgggttctcctttagtagttatggatgaactgggcccgccaggctccgggggaggggccggagtgggtggccaacataatgcaagatggaactgaagaaaactngggggactctgtgaaagggcccgattcaccgatctccagagaccaacgtaagaacttacttagtttactgacaaatgaaacagccctaggggagagccgaggacacggctgtgtattatggtgcggaagggcaggtggcgtaggggacagttcggaccgtcgtgggggccaaaggggcccacgggtccaacccggttcc

SEQ ID NO: 343665 - DNA, 727 bp, Homo sapiens
  misc_feature: GZ8MTXP01EXNAZ.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcacatggaattggggctgagcttgggttttcctcgttggtattttagaaggtgtccagtgtgaggtgcaccgtgggtggaggtcgtggggggaggtcgttggtccaggccggtcggggggtccctgagtactcctcctgtacaggctcgtggttcttcctttagtagttagtggatagacgtcggccccgcgacggccggtaccggggggaagggccggaggtggggtcggaccaacataagtgacaagagtaggaactaggaaacgtaaaaaacgtaggtacggggactcgtgggtggaacgggcgtattaccacctactcctaccgagtaacgaacctaaaccggtaataaaccgtttacgtttacgtttacgtacggaacctaaagtacgaaaccacgacccgtaggggaacggaaccggaccgggaacggaaccgccggtagttggttagtttagtttacggtgggtaacggtacgggaaaggggtccgttagggtcgggcggttagggaacgttaaggttcggggttaccggttccggggtacggggaacccgaaccggggacccggaccggtcccggaaccccgtttcccg

SEQ ID NO: 343666 - DNA, 768 bp, Homo sapiens
  misc_feature: GZ8MTXP01AZI9Y.19.48.E04.1.454.CMB.2.raw
  modified_base (333)..(333): a, c, t, g, unknown or other
  misc_feature (333)..(333): n is a, c, g, or t
  modified_base (421)..(421): a, c, t, g, unknown or other
  misc_feature (421)..(421): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggcttggtccagccgtggggggtccctgagactctcctgtacaggctcgtgggttctcctttagtagttatggatgaactgggacccgcgaggcgtccgggggaagggccggnggtgggtggccaacataatgcaagatggaactgaagaaaactgtgggactcgtgtggaagggccgaattcgaccagtctaccaagganaaccgtaaacgtaaacgttaaccttattacgtttactagacctaaaagttcgaaaaccagacccttagggggaaacggacgggaccccgtaaagggggaccctaaacccgggggtcgttaaggtttacgggtttaaaacgtttttaacggttttcgggggtaaggacccgggggttaaaaaacgggggggtcggttaacgggggttggggttaaccggggttaacgggggaacgttacggggttccgggggttaacccgggttccggggggtaaccgggggaaaccccgggtaaaaccgggggtaccccggttaacccggggttaaccccgttaaccccggttcccg

SEQ ID NO: 343667 - DNA, 688 bp, Homo sapiens
  misc_feature: GZ8MTXP01BWHJR.19.48.E04.1.454.CMB.2.raw
  modified_base (258)..(258): a, c, t, g, unknown or other
  misc_feature (258)..(258): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacgtggtggagtcgtgggggagcttggccagccgtgggggtcctgagactctcctgtacnggcttcgtggttctactttagtagttagtggatgacgtcggccccgcgaggccggtaccggggggaagggccggtaggtcgggtacgaccaaacgtataagtgacaaggagtacggaactacggaaataaaaaccgtggtacggggtactcgtagggtcggaacggggtacccctagttacccaacgtactaccgtaccgaagaaccgaaaccgtaaacggttaaacgtaacctttacgttacgtttactaataccgaaattacgaactacgacctaggggaacgacggccgaggacgcgtcgtggttagttagttagtgtaggcggtaaggcgttagggtgcggtagggtaccaggttcgggttaccggtaacgggtcggggaaccggtacggggacccttaccggggtaacccttaaccccggttccg

SEQ ID NO: 343668 - DNA, 532 bp, Homo sapiens
  misc_feature: GZ8MTXP02HKIGY.19.48.E04.1.454.CMB.2.raw
  modified_base (301)..(301): a, c, t, g, unknown or other
  misc_feature (301)..(301): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtctgggggaggcttggtccagcctggggggtccctgagactctcctgtacaggctctgggttctccttagtagttatggatgaactgggcccnccaggctccgggggaagggccggagtgggtgccaacataatgcaagatggaactgaagaaaaactgtaggggactctgtgaaaggggccattcaccatctccagagacaaaccgtaagaacttacngtttcngtcaaaatgaacagcctgacgagccgaggacacggctgtgtatattggngacgaggcagngcgngacgagngcgcgnggacgacggacgacgcgacgtc

SEQ ID NO: 343669 - DNA, 588 bp, Homo sapiens
  misc_feature: GZ8MTXP02IWQD6.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacnggctctgggttctccttagtagttatggatgaactgggccccgccgaggcgtccgggggaagggccggaggtgggtggccaacataatgacaaagataggaactgaaagaaaaactagtaggggactcgtgtggaacgggccgagttccaaccatcctaccaagaacgaacaaaccgtaaagtaaacttacttgtttcctagactaaaatagaaacagcctaggagacgaccgaggacacggctgtagtattattgtgacggaagggcaggtggcgtgggacagtggacgtcgtcggggaccaacggggaccacgggtccaccgtcc

SEQ ID NO: 343670 - DNA, 574 bp, Homo sapiens
  misc_feature: GZ8MTXP02GG1EA.19.48.E04.1.454.CMB.2.raw
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctcctttagtagttattggatgaactgggcccgcaggctccggggaagggccggagtgggtggccaacataatgcaaagatggaactgaagaaaaactagtaggggaactcgtagtggaaaggggccgtaagttaccacccaatcctacccaagaacgaaccaaacccgtaaagaaactttactgtttacctgactaaatgaacagcctgagagccgagacacggntgtntattgtgngagaggnaggtcggacgaggacagtggacgtggacggggacgaacgggaccgacggtccaccgtc

SEQ ID NO: 343671 - DNA, 565 bp, Homo sapiens
  misc_feature: GZ8MTXP02G1TCQ.19.48.E04.1.454.CMB.2.raw
  modified_base (306)..(306): a, c, t, g, unknown or other
  misc_feature (306)..(306): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggttttccgtcgttaggtatttagaaggtgtccagtgtgaggtgcacctggtggagtctgggggaggcttgggtccagcctggggggtccctgagactctcctgtacaggctctgggttctcctttagtagttattggatgaactgggcccnccaggctccggggaaggggccggagtgggtggccaacataaatgcaagatggaactgaagaaaaactatggggactcgtgtgaaggggccattcaccatctccagagacaaccgtaagaacttatgttctgcaaananacagcngagagacgacggacgacgcgtgtgtattagtgtgacggacggagaggtcggcggtacggacgacgtaggacggtcggtcgggacggaacggaccggaccggtaccgtaccgtccg

SEQ ID NO: 343672 - DNA, 553 bp, Homo sapiens
  misc_feature: GZ8MTXP02GC6RT.19.48.E04.1.454.CMB.2.raw
  modified_base (494)..(494): a, c, t, g, unknown or other
  misc_feature (494)..(494): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctccttagtagttattggatgaactgggcccgcaggctccggggaagggccggaggtgggtggccaacataatgcaagatggaactgaagaaaactagtggggactcgtgtgaagggccgattcaccatctccagagaacaaccgtaagaacttactgttctgacaaatagaacagcctgagagccgaggacacggctgtgtattatgtgcgtaagggcaggnggcgtgggacagtggacgtcggtcgggggaccgaacggggaccgacggtccaccggtcc

SEQ ID NO: 343673 - DNA, 554 bp, Homo sapiens
  misc_feature: GZ8MTXP02JEHPN.19.48.E04.1.454.CMB.2.raw
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (488)..(488): a, c, t, g, unknown or other
  misc_feature (488)..(488): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtgggttctccttagtagttatggatgaactgggcccgcaggctcggggaagggccggagtgggtgcaacatatgcaagataggaactgaagaaaactagtaggggactcgtgtggagggcgattcacatcnccagacacaaccgtaanacttactgttctgacaaatagaacagcctagagagccgaggacacggctgtatattatggtgacggaacgggnaggtcggacgtgggacagtgggacgtcggtgggggaccgaacggggaccacgggtccacccggtcc

SEQ ID NO: 343674 - DNA, 550 bp, Homo sapiens
  misc_feature: GZ8MTXP02GKDEF.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctccttagtagttatggatgaactgggcccgcaggcgtccggggaagggccggagtgggtggccaacataatgcaaagatggaactgaagaaaaactgtaggggactctgtggaagggccgattcaccatctccagagaaccaacgtaagaacttactgttacaacaaatgaaacagacctgaagagcgaggacacggctgtgtattatgtgacgaagggcagtggctgggacagtcggacgtcgtggggccaaggggaccacggtcaccggtctcccg

SEQ ID NO: 343675 - DNA, 560 bp, Homo sapiens
  misc_feature: GZ8MTXP02HMWN5.19.48.E04.1.454.CMB.2.raw
  modified_base (434)..(434): a, c, t, g, unknown or other
  misc_feature (434)..(434): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactggcccgccaggctccggggaagggccggagtgggtggccaacataatgcaaagatggaactgaagaaaaactataggggactcgtgtgaagggccgattcaccatctccagagacaacgtaagaacttactgtttcngacaaatgaacagcctagagagccgaggacacggctgtgtattattgtgcggaaagggcaggtggcgtaggggacagtggaacgtcgtgggggaccaaaggggaccctacgggtccaaccggtccc

SEQ ID NO: 343676 - DNA, 595 bp, Homo sapiens
  misc_feature: GZ8MTXP02G7YUJ.19.48.E04.1.454.CMB.2.raw
  modified_base (506)..(506): a, c, t, g, unknown or other
  misc_feature (506)..(506): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtcgtgggggaggcttggtccagccgtggggggtcctgagactctcctgtacaggctctggggttctcctttagtagttattggatgaactgggcccgcaggctccggggaaggggccggagtgggtggccaacataaatgacaaagatgggaaactagaagaaaaaaactagtagggggaactcgtggtggaaaggggcccgaatttccaaccaatctacccaagagaaccaaaccgtaaagaaacttaactgtttcctgacaaaatgaaacaagcctagagagccgaggacacggcngtgtattatgtgcgaaggcaggtggcgtaggacgacgaggacggtcgtcggggaccggaacgggaaccgaccggtaccgaaccgtcccg

SEQ ID NO: 343677 - DNA, 569 bp, Homo sapiens
  misc_feature: GZ8MTXP02F1NG4.19.48.E04.1.454.CMB.2.raw
  modified_base (301)..(301): a, c, t, g, unknown or other
  misc_feature (301)..(301): n is a, c, g, or t
  modified_base (465)..(465): a, c, t, g, unknown or other
  misc_feature (465)..(465): n is a, c, g, or t
  modified_base (515)..(515): a, c, t, g, unknown or other
  misc_feature (515)..(515): n is a, c, g, or t
tcagtactctcgtgcacgaccggtgctcgatttagagagcgtcacagagagaaggggtctcagagaggagccttagccctggactccaaggcctttccacttggtgatcagcactgagcacagacgactcaccatggaattggggctgagcgtggtttcctcgttaggtatttagaaggtgtcagtgtgaggtgcacctggtggagtctgggggaggcttggtccagcctggggggtccctgagactctcctgtacaggctctggggttctcctttagtagttatggatgaactgggcccncaggctccggggaagggccggagtgggtggccaaacataaatggcaaagatggaactgaagaaaaactagtggggaactcgtgtggaaagggcccgaattccaccaatctccaagagacaaacccgtaagaaacttactgttctagacaaaatagaacagaccngagagcgaggacgaacgcgtgtgtattattgtgagaacggagagtcgggngacggacgacgtagacgtcggtcggacggaacggacgaccggtaccgacgtccg

SEQ ID NO: 343678 - DNA, 581 bp, Homo sapiens
  misc_feature: GZ8MTXP02JFRZG.19.48.E04.1.454.CMB.2.raw
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctccttagtagttatggatgaactgggcccgccaggctccggggaagggccggagtgggtggcaacgataatgcaagatggaactagaagaaaaactagtaggggactcgngtggaagggccgattcaccatctccaganacaaaccgtaagaacttactgtttccagacaaatgaacagcctagagacgcgagacacggctgtgtattatgtgacggtaagggcaggtggcgtaggggacctaagtcgggacgttcggtcgggggacccgaaacgggggacccgtacggggtcccaacccggttcccg

SEQ ID NO: 343679 - DNA, 586 bp, Homo sapiens
  misc_feature: GZ8MTXP02H40NA.19.48.E04.1.454.CMB.2.raw
  modified_base (456)..(456): a, c, t, g, unknown or other
  misc_feature (456)..(456): n is a, c, g, or t
  modified_base (583)..(583): a, c, t, g, unknown or other
  misc_feature (583)..(583): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctcctttagtagttattggatgaactgggccccgccaggcgtccgggggaaggggccggaggtggggtggccaacataatgtaaagatggaactgaagaaaaactagtggggactctggtgaggggccgattccaccatctcagagacaaaccgtaagaacttatgtttactgacaaatgaaacngcctagagagccgaaggacgacggctgtagttattattgtgcggaaaggcaggtggcgtaggggactagtcgggacgtcgtgggggacccgaaaaggggacccgtacgggtaccacccggtttcccnccg

SEQ ID NO: 343680 - DNA, 567 bp, Homo sapiens
  misc_feature: GZ8MTXP02JGNV2.19.48.E04.1.454.CMB.2.raw
  modified_base (447)..(447): a, c, t, g, unknown or other
  misc_feature (447)..(447): n is a, c, g, or t
  modified_base (500)..(500): a, c, t, g, unknown or other
  misc_feature (500)..(500): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtgggttctccttagtagttatggatgaactgggcccgccaggctccggggaagggccggaggtgggtggccaacataaatgcaaagatagggaactgaagaaaaactgtaggggactcgtgtggaaaggggccgattcaccatcctaccagagaccaaaccgtaagaacttactgtttcngacaaatcgaaacagcctaggagagccgaggaccacggctgtgtattagttgngacggaaggcaggtggcgtggggacagtggacgtcgcggggacaacggggaccacgggtcaccgtcc

SEQ ID NO: 343681 - DNA, 567 bp, Homo sapiens
  misc_feature: GZ8MTXP02H6W22.19.48.E04.1.454.CMB.2.raw
  modified_base (374)..(374): a, c, t, g, unknown or other
  misc_feature (374)..(374): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctggagactctcctgtacaggctctggggttctccttagtagttattggatgaactggccgccaggctccggggaagggccggagtgggtggccaacataaatgacaagatggaactagaagaaaaaactntagggggactcgtggtgaaagggggtccaatttccgaaccatctaccagaagaacaaaccgtaagaactacttgtttctagacaaatgaaacagcctagagagccgaggacacggcngtntattatgtgacgaagggcaggtcgcgtgggacagtggacgtcgtggggaccaagggaccacggtcaccggtcc

SEQ ID NO: 343682 - DNA, 641 bp, Homo sapiens
  misc_feature: GZ8MTXP02JHYZH.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggtttccgtcgttaggtatttagaaggtgtcagtgtgaggtgcacctggtggagtcgtgggggagcttggtccagccgtgggggtccctgagactctcctgtacaggctctgggttctcttagtagttattggatgaacgtggcccgccaggcgtcggggaagggccggagtgggtggccaacataatgcaaagataggaactagaagaaaaactgtaggggactcgtagtggaaacgggccgtattccaacctatcctacccgaagaacgaaaccgtaaaacccgtaaagtaaaccctttaacgttcgtttaccgtagtaacctaaaagtacgaaaccacggacccttaggaacggaacgacccggaagggaaccgaacgggtcgtggttagtatttagttggtagacgggaagggcgtaggtggcgtacggacgagtcggacggtcggtcgggacggacggaccggaccggtaccgaccgtcccg

SEQ ID NO: 343683 - DNA, 562 bp, Homo sapiens
  misc_feature: GZ8MTXP02J11P7.19.48.E04.1.454.CMB.2.raw
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctgggggtccctgagactctcctgtacaggctctgggttctccttagtagttattggatgaactgggcccgccaggctccggggaagggccggagtgggtgccaacataatgcaaagatggaactgaagaaaaactatggggactctgtgaaagggccgattcaccatcnccagagacaaccgtaagaacttactgtttctgacaaatgaaacngctagagagcggaggacgacggctgtagttattagttgtggacggagggcgaggtcggcgtcggacagtcgggacgtcggcgggggaccgaaacgggaccgacggtccgaccgtccg

SEQ ID NO: 343684 - DNA, 559 bp, Homo sapiens
  misc_feature: GZ8MTXP02GHLTR.19.48.E04.1.454.CMB.2.raw
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctctgggttctcctttagtagttattggatgaactgggccccncaggctccgggggaagggccggagtgggtggccaacataatgcaagatggaactgaagaaaaactgtggggactcgngtgaaagggcgattcaccatcnccaganacaacgtaagacttntgttcngtacaaatgaacagcctgagagccgaggacacggctaggtgtattagtgtgacggaagggcaggtggcgtggggacaggtcggacgtcggtacggggaccaaacggggcccacggttccaccggttcc

SEQ ID NO: 343685 - DNA, 541 bp, Homo sapiens
  misc_feature: GZ8MTXP02H4692.19.48.E04.1.454.CMB.2.raw
  modified_base (477)..(478): a, c, t, g, unknown or other
  misc_feature (477)..(478): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagcctggggggtccctgagactctcctgtacaggctctgggttctccttagtagttattggatgaactgggccccgccgaggcgtccgggggaaggggccggaggtggggtggccaacataaatgcaaagatggaactgaagaaaaactagtaggggactcgtgtggaagggcagttcaccatctccagagacaaacgtaagaacttactgtttcagacaaaatgaacagctgagagccgagacacgnngtgattatgtgcgaaggcagtggngngacgagngngtcgcggacgacggacgacgcgacgtcg

SEQ ID NO: 343686 - DNA, 553 bp, Homo sapiens
  misc_feature: GZ8MTXP02F4N0P.19.48.E04.1.454.CMB.2.raw
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (486)..(486): a, c, t, g, unknown or other
  misc_feature (486)..(486): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctccttagtagttattggatgaactgggcccgccaggctccgggggaaggggccggaggtgggtggccaaacataaatgacaaagataggaactgaagaaaactagaggggactctgtgaaggggccgattcaccatcnccaganacaacgtaanaacttactgttctgacaaatgaacagcctagagacgccgagggaccacggctgtgtattntagtgcgaagggcaggtcggctaggggacagtggacgtgtggggaccaagggccacggtcaccgtcc

SEQ ID NO: 343687 - DNA, 573 bp, Homo sapiens
  misc_feature: GZ8MTXP02HPNJ9.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctggggggaggcttgggtccagccgtggggggtccctggagactctcctgtacaggctctggggttctcctttagtagttattggatgaactgggcccgccaggctccgggggaagggccggaggtgggtggccaacataatgcaaagatggaactgaagaaaaactagtaggggactcgtgtggaaggggccgattccaccatctccagagacaaccgtaagacttactgtttctgacaatgaacagcctgagagcgaggacacggctgtgtattagttgtgacggaagggcaggtggcgtggggacagtgggacgtcggtcgggggaccgtaacggggacctaccgggtctaccggttccc

SEQ ID NO: 343688 - DNA, 545 bp, Homo sapiens
  misc_feature: GZ8MTXP02I4IEO.19.48.E04.1.454.CMB.2.raw
  modified_base (517)..(517): a, c, t, g, unknown or other
  misc_feature (517)..(517): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtctgggggaggcttggtccagcctggggggtccctgagctctcctgtacaggctctgggttctcctttagtagttatggatgaactgggcccgccaggctccggggaagggccggagtgggtgccaacataaatgcaaagatggaactgaagaaaaactagtaggggactcgtgtggaaagggcccgattcaccatctaccagagacaaacgtaagaacttactgttctgacaaatgaacagctgagagccgaggacacggctgtgtattatgtgcgaagggcaggtggctgggacagtcggacgtcgnggggaccaaggggaccacggtcaccgtc

SEQ ID NO: 343689 - DNA, 557 bp, Homo sapiens
  misc_feature: GZ8MTXP02F6PTL.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccgggggaagggccggagtgggtggccaacataatgcaagataggaactggaagaaaaactagtaggggactcgtggtggaagggccgagttccaccatctccagagacaaccgtaaagaacttactgtttctagacaaatgaacagcctagagagccgaggacacggctgtgtatatgtgcgaaggcagtcggcgtgggacagtggacgtcgtaggggaccaacggggaccacgggtcaccgtcc

SEQ ID NO: 343690 - DNA, 544 bp, Homo sapiens
  misc_feature: GZ8MTXP02H3ZJK.19.48.E04.1.454.CMB.2.raw
  modified_base (430)..(430): a, c, t, g, unknown or other
  misc_feature (430)..(430): n is a, c, g, or t
  modified_base (516)..(516): a, c, t, g, unknown or other
  misc_feature (516)..(516): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcttagtagttatggatgaactggcccgcaggctccggggaagggccggagtgggtgccaacataatgcaagatggaactgaagaaaaactagtaggggactcgtgtggaagggccgattcaccatctccagagacaacgtaagaacttactgtttcngacaaatgaacagcctagagagccgaggacacggctgtagatttagtgtgacggaagggcaggtggcgtgggacagtggacgtcgngggggaccaagggaccacggtcaccgtc

SEQ ID NO: 343691 - DNA, 559 bp, Homo sapiens
  misc_feature: GZ8MTXP02HX40B.19.48.E04.1.454.CMB.2.raw
  modified_base (325)..(325): a, c, t, g, unknown or other
  misc_feature (325)..(325): n is a, c, g, or t
  modified_base (460)..(460): a, c, t, g, unknown or other
  misc_feature (460)..(460): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtctgggggaggcttggtccagcctggggggtccctgagactctcctgtacaggctctggggttctccttagtagttattggatgactggcccgcaggctccggggaagggccggagngggtggccaacataatgacaaagataggaactgaaagaaaaactgaggggactcgtgtgaagggccgattccgactatctcccaagacgaacaaccgtaagaaccttactgtttctgacaaatgaaacagtaccngagagaccgaggacaggctgtagtattattgtgacggtaaggcaggtcgcgtggggacagtggacgtcgaggggaccaagggaccgacggtcaccgtcc

SEQ ID NO: 343692 - DNA, 557 bp, Homo sapiens
  misc_feature: GZ8MTXP02F05CU.19.48.E04.1.454.CMB.2.raw
  modified_base (489)..(489): a, c, t, g, unknown or other
  misc_feature (489)..(489): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttatggatgaactggcccgcaggctccggggaagggccggaggtggtggccaacgataatgcaagatggaactgaagaaaactagtaggggactcgtggtgaagggccgattccgacctatctcccagacgacaaaccgtaagaacttatgttctgacaaatagaacagcctagagagccgaggacacggctgtgtattattgngacgaagggcagtggctgggacagtgggacgtcggtaggggaccaacggggccaacggtcgaccgtcc

SEQ ID NO: 343693 - DNA, 608 bp, Homo sapiens
  misc_feature: GZ8MTXP02HLQIA.19.48.E04.1.454.CMB.2.raw
  modified_base (575)..(575): a, c, t, g, unknown or other
  misc_feature (575)..(575): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcttagtagttatggatgaactgggcccgccaggcgtccgggggaaggggccggagtggggtcggccaaacataaatgcaaagatggaaactgaaagaaaaactgtggggactcgtgtggaaggggccgattccaaccatctacccaagacgaaccaaaccggtaaagaactttacgtgttttctagactaaagtagaaacagcctggaagacggaccggaagggaccacgggacgtggtagttaagttattggtaggacggaaaggggcaggttcggcgtagggactagtggacgtcggnggggaccaacgggggccaccgggtcaccgtccg

SEQ ID NO: 343694 - DNA, 669 bp, Homo sapiens
  misc_feature: GZ8MTXP02F08OO.19.48.E04.1.454.CMB.2.raw
  modified_base (258)..(258): a, c, t, g, unknown or other
  misc_feature (258)..(258): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggttttcctcgttggtatttagaaggtgtccagtgtgaggtgcactggtggagtcgtgggggagcttggtccagccgtgggggtccctgagactctcctgtacnggctcgtggttctcttagtagttatggatgacgtcggcccgcgaggcgtccgggggaagggccggaggtgggtggaccaacataatgacaaagataggaactagaaagaaaactagtaggggactcgtgtgggaagggccgtattaccacctatcctaccaagacgaaaccaaaccgtaaagtaactttacttgttactagaactaaatacgaaacacgccgtaggaacggacgacccggaagggaaccgaccgggtcgttaggttagttaatttagttggtagggaaccgggaaaggggtcgaagggttgggacggttacgggggtaacaaggttcggggtaccgttcgggtacgggggaacccggaaaacgggggtacccccgaacggggttcccaacccggtttcccg

SEQ ID NO: 343695 - DNA, 602 bp, Homo sapiens
  misc_feature: GZ8MTXP02FLBRT.19.48.E04.1.454.CMB.2.raw
  modified_base (502)..(502): a, c, t, g, unknown or other
  misc_feature (502)..(502): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggtttctcgttaggtatttagaaggtgtccagtgtgaggtgcacctggtggagtctgggggagcttggtccagcctgggggtccctgagactctcctgtacaggctctgggttctcctttagagttatggatgaactgggcccgcaggctccgggggaagggccggagtgggtggccaacataatggcaagatggaactgaagaaaaactatggggaactcgtgtggaaacgggccgattcaccatcctccaagaggaaccctaaaccgtaaaagaactttaacgttgtttaccttagacctaaaataggaaacaaggccctaggagagcccgaaggacaaccgggtntagtagtattagtgtagacggaagggcgaggtggcggtacggacgacgtaggtacggtcggtcgggacggaacgggaccggaccggtaccgtaccgtccg

SEQ ID NO: 343696 - DNA, 578 bp, Homo sapiens
  misc_feature: GZ8MTXP02F1HDB.19.48.E04.1.454.CMB.2.raw
  modified_base (491)..(491): a, c, t, g, unknown or other
  misc_feature (491)..(491): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttattggatggactgggccccgccgaggcgtccgggggaaggggccggaggtggggtggccaacataatgacaagatggaactgaagaaaaactagtggggactcgtgtgaagggccattccaccatctcccaagacgaacaaaccgtaaagaactttacttgtttctagacaaatagaaacagcctagagagccgaggacacggntgtgtattagtgtgcgaaagggcaggtggctggggacagtggaacgtcgtacgggggaccaaaggggacccacgggtccaccgtccg

SEQ ID NO: 343697 - DNA, 563 bp, Homo sapiens
  misc_feature: GZ8MTXP02I46F7.19.48.E04.1.454.CMB.2.raw
  modified_base (445)..(445): a, c, t, g, unknown or other
  misc_feature (445)..(445): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctccttagtagttattggatgaactgggccccgcaggcgtccgggggaaggggccggaggtggggtggccaacataatgcaaagatggaactagaagaaaaactgtaggggactcgtgtggaaagggccgattccaccatctccagagacaaacgtaagaacttatgtttcngacaaatgaacagcctagagagccgaggacacggctgtgtattattgtgcgaaggcaggtggcgtggggactagtcgggacgtcgtaggggaccaaggggaccacggtccaccgttcc

SEQ ID NO: 343698 - DNA, 541 bp, Homo sapiens
  misc_feature: GZ8MTXP02FQKYM.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctggggttctcctttagtagttattggatgaactgggcccgcaggctccggggaaggggccggagtggggtggccaacataatgcaaagatggaactgagaaaactatggggactctgtgaaggggccgattcaccatctccagagacaaccgtaagaacttactgtttctgacaaatgaacagcctgagagccgaggacacggctgtgtatattgtgcggaagggcagtggctgggacagtggacgtgtggggccaaggggaccacggtcaccgtc

SEQ ID NO: 343699 - DNA, 562 bp, Homo sapiens
  misc_feature: GZ8MTXP02IBPHF.19.48.E04.1.454.CMB.2.raw
  modified_base (533)..(533): a, c, t, g, unknown or other
  misc_feature (533)..(533): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggaggcttgggtccagccgtggggggtccctgagactctcctgtacaggctcgtgggttctcctttagtagttattggatgaactgggcccgccaggcgtccgggggaaggggccggaggtggggtggccaacataaatgacaaagatggaactgaaagaaaaactagtaggggactcgtgtggaacgggccgattcaccatctccagagacaaaccgtaagaactactgtttcagacaaatgaacagcctgagagccgaggacacggctgtgtattagtgtgcgaagggcaggtggcgtgggacagtggacgttcgnggggaccgaagggaccacggtccacgtcc

SEQ ID NO: 343700 - DNA, 565 bp, Homo sapiens
  misc_feature: GZ8MTXP02I5RFB.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctccttagtagttatggatgaactgggcccgcaggctccgggggaagggccggagtggggtggccaaacataaatgacaaaggataggaactaggaagaaaaactagtaggggactctgtgaaggggccattcgaccatctccaagagacaaaccgtaagaaaccttattgttctagcaaatgaaacagcctagagagccgaaggacacggctgtgtattagtgtgcgtaagggcaggtggactggggacagttggacgtcgtcggggaccgaacgggacacggtcaccggtcc

SEQ ID NO: 343701 - DNA, 629 bp, Homo sapiens
  misc_feature: GZ8MTXP02JYEY8.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtgggggtccctgacgactctcctgtacaggctcgtggttctcctttagtagttatggatgacgtcgggcccgcgaggcgtaccgggggaagggccggaggtggggtcggaccaaacgataaagtgacaaagagtaggaactagaaagtaaaaactgtaggggactcgtgtaggaacgggccgtattccgacctatccaccaagacgaacaaaccgtaagtaacttacttgtttcagaactaaagtacgaactagcctaggacgacgaccggaggaccgacggtcttgtagttattagttgtgacggaagggcagggtcggtacgagggacctaggtcgggacggtcggtacgggggaaccgaacggggaccctacggggtacccaccggttccc

SEQ ID NO: 343702 - DNA, 745 bp, Homo sapiens
  misc_feature: GZ8MTXP02GPQYX.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctcctttagtagttattggatgaactgggcccgccaggctccggggaagggccggagtgggtggccaacataatgacaagatggaactgaagaaaaactagtagggggaacttcgtagtgggaaggggcccgtaagtttccaacccgaatcctacccaaggacgaaaccgtaaacccgttaaaggaaacctttaacgttaggttttaccctaggaaccaaaaagttcggaaaacctaagggccccttaggaaacggaacggaccccgggaaaggggaacccaaaccggggtccgttagggttagtttaaacgttttaagtttggttgggaaccggtaaaagggggcctaaaggggtcggggtaccgttagggggaacctaaggttacgggggtaaccgttccgggtacgggggggaacccgtaaaaacggggggacccccgtaaacgggggttccccgtaaccggtttcccccg

SEQ ID NO: 343703 - DNA, 775 bp, Homo sapiens
  misc_feature: GZ8MTXP02IC9NZ.19.48.E04.1.454.CMB.2.raw
  modified_base (247)..(247): a, c, t, g, unknown or other
  misc_feature (247)..(247): n is a, c, g, or t
tcagtactctcgtgcacgaccggtgctcgatttagagagcgtcacagagagaagggggtcgtcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggaggcttggtccagccgtgggggtccctgngactctcctgtacaggctctgggttctcttagttagttattggatgactcgggcccgccgaggcgtccgggggaaggggccggaggtggggtggaccaacataaatgcaaagatggaactgaaagaaaaaccgtagtaggggaacttcgtaggtggaaacgggggccgaagtttacccaacctaactccttaccccgaagaaacggaaacccgaaaacccggttaaagtaaaaccctttaaccgtttaggtttttaccctaggtaacctaaaaagttcggaaaaccaacgggtccccgttaaggaacgggaacgggaccccgggaaggggtaaacccgaacgggtccgttaggttaggtttaatttttaagttgggttacgggaaccgggtaaaagggggcgtaagggtgggtaccggttagggggaaccgtaggtttacgggggaaaccggtttcggggtaccggggggaacccggtaaaacggggggaacccgtacccggggtacctaaccccggggtttcccccg

SEQ ID NO: 343704 - DNA, 675 bp, Homo sapiens
  misc_feature: GZ8MTXP02G14RA.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctctttagtagttatggatgaacgtcgggcccgccgagggcgtccggggggaaggggcccggaggtggggtcggaccaaacagtaaagtggacaaaggagtaggaactaggaaagaaaaactagtagggggacttcgtggtaggggaaggggtcccgtaagttccaacctagtcctacccgaaagtaacgaaacccgtaaaccgtaaagtaaacctttacgttgttttaccaggtacaaaatgaaactagcccgtaggacgacggacccggaggacgacggcttaggtagttaattagttggtacgacgggtaaagggctaggtcgggacgtaggggactaggtcgggtacggtcggtacgggggacccaaacgggggacccacgggtacccaccggttcccg

SEQ ID NO: 343705 - DNA, 597 bp, Homo sapiens
  misc_feature: GZ8MTXP02JL1K3.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtgggttctcctttagtagttatggatgaactgggcccgccaggcgtccgggggaaggggccggaggtgggtggccaaacataaagtgacaaagataggaactgaagaaaaactagtaggggactcgtgtggaagggccgtattccacctatctaccagacgaaccaaaccgtaagaactttacgtgtttcagacaaatgaacagcctagacgacgaccgaggacacggctggtagtattattgtgacggtaagggacgaggtcggcggtacgggacgaagtggatcggtcgtacgggggaccggaagggacccgacggtcgtaaccccgg

SEQ ID NO: 343706 - DNA, 612 bp, Homo sapiens
  misc_feature: GZ8MTXP02IKTT9.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctgggggtccctgagactctcctgtacaggctctgggttctcctttagtagttattggatgaactgggccccgccaggctccggggaagggccggagtgggtggccaacataatgacaagataggaactggaagaaaactagtaggggacgtactcgtggaagggaccggacttacaccgactctccagagaaccaaccgtaaacgaacttaacttgttttcttagtacgaaataagaacgaagtaccgtacgtaaggacgaccgagggaaccgacggcgtagttggttattagtttagtgcggtaagggacgagtagggtcgtagggacgaagtggacggtcgtcggggtacggaacgggacgaccggtacgacctacccg

SEQ ID NO: 343707 - DNA, 569 bp, Homo sapiens
  misc_feature: GZ8MTXP02I7UGT.19.48.E04.1.454.CMB.2.raw
  modified_base (260)..(260): a, c, t, g, unknown or other
  misc_feature (260)..(260): n is a, c, g, or t
  modified_base (423)..(423): a, c, t, g, unknown or other
  misc_feature (423)..(423): n is a, c, g, or t
  modified_base (446)..(446): a, c, t, g, unknown or other
  misc_feature (446)..(446): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggaggcttggtccagccgtgggggtccctgagactctcctgtacnggctcgtgggttctccttagtagttatggatgaacgtgggcccgccaggcgtccgggggaaggggccggaggtggggtggaccaacataaatgacaaagatagggaactagaaagaaaaactagtggggactctaggtggaagggccgattcacatctcaganacaacgtaagaacttactgttcngacaaatgaacagcctagagagccgaggaccacggctgttgtaattagtgtgacggaaagggcaggtcggctagggacagtgggacgttgcgggggaccaaaggggccacgggtccacggtcc

SEQ ID NO: 343708 - DNA, 770 bp, Homo sapiens
  misc_feature: GZ8MTXP02FVM9B.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctctgggttctcctttagtagttattggatgaactgggccccgcgaggcgtcgggggaagggccggaggtgggtggccaacataatgacaaagagtaggaactagaaagaaaaacgtagtagggggtaactcgttaggtggaaggggcccgtaagtttccaacccagttcctacccgaaggaaacgaaaccctaaaacccggttaaagtaaaacccttttaacgttcggttttaccgttaggaacctaaaagttacggaaaacctacggtaccccgtaagggaaacggacggaccccgggaacggggaaacctacccggggtacgttggttaacggtttaaatttagttgggtacgggacgggtaaaagggggcctaggggttcgggggacgttaggggggaaaccttaaggggttcgggggtaaaccggttccggggttacggggggaacccggtaaaaccggggggaacccctaccggggggtacccctacccggggtttccccg

SEQ ID NO: 343709 - DNA, 567 bp, Homo sapiens
  misc_feature: GZ8MTXP02IWXVN.19.48.E04.1.454.CMB.2.raw
  modified_base (439)..(439): a, c, t, g, unknown or other
  misc_feature (439)..(439): n is a, c, g, or t
  modified_base (487)..(487): a, c, t, g, unknown or other
  misc_feature (487)..(487): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagccgtgggggtccctgagactctcctgtacaggctctgggttctcctttagtagttatggatgaactgggcccgccaggctccggggaagggccggagtgggtggcaacataatgcaaagataggaactgaagaaaactagtggggactcgtggtggaagggccgattccgacctatcctccagagaacaacgtaagaacttactgtttcngacaaatgaacagcctagagagccgaggacacggctgtgtattattgngacggaagggcaggtcggcgtaggggacagtcggacgtcggtcgggggaccgaaacggggcccacgggtcacccggttcc

SEQ ID NO: 343710 - DNA, 763 bp, Homo sapiens
  misc_feature: GZ8MTXP02HA05H.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtgggttttcctcgttggtatttagaaggtgtccagtgtgaggtgcacctggtggagtcgtgggggagcttggtccagccgtgggggtccctgagactctcctgtacgngctcgtggttctcgttagtagttagtgatgacgtcggcccgcgacggccggtaccgggggaacgggccggtaggtcgggtacggaccaaacgtagtaagtgacgaaagtagtaggaactaaggaaaacgtaaaacgtaggtacggggtactacggtagggtacgggaacgggaccgtacttaccgaactactccgaccgaaagaaacgtaaacccgtaaaaccgtaaacgttaaaccgtttacgttacgtttacctacgaaactaaaagtacgaaacgtacgtaccgtaaggaacggacggaccgggaaacgggtaaccgaccggtacgttaggttagtttaagtttaggttacggtacgggaacgggtaaacggggtcgtaggggtacgggtacgggtaacggggtaacgtacgggtacgggtacggttaaccggggtaaccgggggaaaacccgtaaacggggtacccccggtaacgggttaccccgtacccggttaccc

SEQ ID NO: 343711 - DNA, 552 bp, Homo sapiens
  misc_feature: GZ8MTXP02H971U.19.48.E04.1.454.CMB.2.raw
  modified_base (305)..(305): a, c, t, g, unknown or other
  misc_feature (305)..(305): n is a, c, g, or t
  modified_base (482)..(482): a, c, t, g, unknown or other
  misc_feature (482)..(482): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttattggatgaactgggcccncaggctccggggagggccggagtgggtggccaacataaatgtaaagatggaaactgaagaaaaactgtggggactctgtgaggggccgattccaccatctccagagacaaccgtaagaacttactgtttctagcaaatgaacagcctgagagccgagacacggctgtgtattattgngcgaagggcaggtggctggggacagtcgggactcggtgggggaccaaggggaccacgggtccaacactcc

SEQ ID NO: 343712 - DNA, 703 bp, Homo sapiens
  misc_feature: GZ8MTXP02JC720.19.48.E04.1.454.CMB.2.raw
  modified_base (549)..(549): a, c, t, g, unknown or other
  misc_feature (549)..(549): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtgggggtccctgagactctcctgtacaggctcgtgggttctccttagtagttatggatgaacgtgggcccgcgagggccgtccgggggaaggggccggaggtggggtcggaccaacataatgacaagagtaggaactaggaaagaaaaacgtgtaggggactcgtgggtaggaacgggccgtagttccaaccgtattccctacgaacgaacgaaaccgtaaaacccggtaaagtaaacctttaacttgtttactagaacctaaaataggaaacaagccgtaggaacggacgaccggaagggaaccgaaccgggngttagttagttaagttagttggtacggacgggtaacggggtacgtagggtcgggtacggtacggggtaacgtacgggtacgggtacggttaaccgggtacgggggaacccggtaaacggggaccccggtaccgggtaccccgacccggttcccg

SEQ ID NO: 343713 - DNA, 572 bp, Homo sapiens
  misc_feature: GZ8MTXP02FI9S9.19.48.E04.1.454.CMB.2.raw
  modified_base (348)..(348): a, c, t, g, unknown or other
  misc_feature (348)..(348): n is a, c, g, or t
  modified_base (490)..(490): a, c, t, g, unknown or other
  misc_feature (490)..(490): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttatggatgaactgggcccgcaggcgtccgggggaaggggccggaggtgggtggccaacataangacaagatggaactagaagaaaaactagtaggggactcgtggtggaaggggcccgattccaccatcctccaagagaacaaaccgtaaagtaacttaactgttctagtacaaatagaacagcctagagagccgaggacacggntgtgtattatgtgacggaagggcaggtggcgtggggacagtggacgtcgcggggaccgaaacgggccgacggtcaccgttcc

SEQ ID NO: 343714 - DNA, 790 bp, Homo sapiens
  misc_feature: GZ8MTXP02G54NY.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctggagactctcctgtacaggctcgtgggttctccttagtagttattggatgaactggcccgcgaggcgtccggggaaggggccggagtgggtgaccaacataaagtgacaaagagtaggaaactagaaaagaaaaaactgtaggggactcgtaggtaggaaacggggccgtaattaccaacctaattcctacccgaaagaacgaaaccgtaaaacccggtaaaacgtaaacctttaacgtttacgttttacctacggtaaactaaaaagttacggaaaacctaaacggacccgttaagggaaacggaacgggaccccgggaaggggaaacccgaacccggggtacgttaggtttaggttaaacgttttaaggtttgggtagggaaccgggtaaaagggggccgtaaagggggttggggaccggtttagggggaacctaaacgggtttcggggaaacccggttccgggttacggggggaaaccccggaaaacgggggaacccccgtaaaaccgggggttccccgtaaaccccgggtttacccccg

SEQ ID NO: 343715 - DNA, 574 bp, Homo sapiens
  misc_feature: GZ8MTXP02JHJA1.19.48.E04.1.454.CMB.2.raw
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagccgtgggggtccctgagactctcctgtacaggctcgtgggttctcctttagtagttatggatgaactgggcccncaggcgtccggggaagggccggaggtgggtggccaacataatgcaagagtaggaactgaagaaaaactgtaggggactcgtgtggaagggccgattccacctagtcctaccagacgaaccaacgtaagaacttacgtntttccngtacaaatcgaaacagcctagaagagaccggaggacacggctaggtgtattattggtgacggaagggcaggtcggcgtagggacagtggacgtcgtcggggaccgagggaccacggtaccaccgtcg

SEQ ID NO: 343716 - DNA, 589 bp, Homo sapiens
  misc_feature: GZ8MTXP02F3EUX.19.48.E04.1.454.CMB.2.raw
  modified_base (334)..(334): a, c, t, g, unknown or other
  misc_feature (334)..(334): n is a, c, g, or t
  modified_base (485)..(485): a, c, t, g, unknown or other
  misc_feature (485)..(485): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagccgtggggggtccctgagactctcctgtacaggctctgggttctcctttagtagttatggatgaactggcccgcaggctcggggaagggccggagtggtgccaanataatgacaagataggaactgaagaaaaactagtaggggaactcgtaggtggaaggggcccgaattccaccatctaccagacgacaaaccgtaaagaactttactgtttctgactaaatgaaacagcctgaagagaccgaggacacgggtntgtagttattagtgtagacggaacgggcgaggtcggacgtacgggacgtagtcgggtacggtcggtacggggaaccgaacgggaccgtacggtcccgaccgtcc

SEQ ID NO: 343717 - DNA, 664 bp, Homo sapiens
  misc_feature: GZ8MTXP02JS7VE.19.48.E04.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcacctggtggagtcgtgggggaggcgttggtccagccgtgggggtccctgagctctcctgtacnggctcgtgggttctcttagtagttntggatgacgtcggcccgcgaggcgtccggggagggccggaggtgggngccaacatatgacaagagtaggaactaggaaagaaaaacgtagtacggggacttcgtaggtagggaacggggccgtaacgttccaacctactccctacccgaaagacgaaacccgtaaacccgtaaagtaaacctttacgttgtttaccagtaacctaaagtacgaaacgacgtacctaggacgacggaccggagggaccgacgggtcgttaggttagttatttagttggtagacgggaacgggtcagggtcgggacgtaggggactaggtacgggacgtcgggtacgggggaccgtaacggggacccgaccgggttccgaccgttcccg

SEQ ID NO: 343718 - DNA, 583 bp, Homo sapiens
  misc_feature: GZ8MTXP02FR7PA.19.48.E04.1.454.CMB.2.raw
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctcgtgggttctcctttagtagttattggatgaactgggccccgcaggcgtccgggggaaggggccggaggtggggtggccaacataaatggacaaagataggaactgaagaaaaactagtaggggactcgtggtggaaacggggccgtattccgacctatcctaccaagacgaaccaaccgtaaagaactttacgtgtttctagacaaatgaacagcctagagacgccgaggacacggntgtgtatntgtgcgaaggcagtggctagggacagtcggacgtcgtagggggaccaacggggaccacggtccaccggttcc

SEQ ID NO: 343719 - DNA, 704 bp, Homo sapiens
  misc_feature: GZ8MTXP02GOIXO.19.48.E04.1.454.CMB.2.raw
  modified_base (259)..(259): a, c, t, g, unknown or other
  misc_feature (259)..(259): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtctgggggaggcttggtccagccgtgggggtccctgagactctcctgtacnggctctgggttctccttagtagttattggatgaacgtgggccccgccaggccgtccgggggaaggggccggaggtggggtggccaaacataatgacaaagataggaactagaagaaaaactagtaggggactcgtagtggaagggccgaattccgacctatcctaccaagacgaaaccaaaccgtaaagaacctttacgtagtttccagacctaaaagtacgaaacaggaccctaggaacgacggacccggaacgggaacccaccgggggtaccttagggttagtttaaagtttagtttcggtaggtaaccggggaaaagggggtccgaaagggtttccgggggtacggttacgggggaacgtaggtacggggtaccggtccggggtacgggggaacccggtaaacgggggaccccgtaaccgggtacccgtaaccccggtcccg

SEQ ID NO: 343720 - DNA, 572 bp, Homo sapiens
  misc_feature: GZ8MTXP02IECVQ.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggccccgccaggctccgggggaaggggcccggaggtgggtggccaacataatgcaagatggaactgaagaaaaactagtggggactctgtggaagggccgattcgaccatctaccagagaccaacgtaagacttactgtttctagacaaatgaacagcctagagacgccgaggacacggctgtgtattagttagtgacggaagggcaggtcggctacggggacagtgggacgtcggtacgggggaccaacggggaccctacggtcaccggttcc

SEQ ID NO: 343721 - DNA, 687 bp, Homo sapiens
  misc_feature: GZ8MTXP02GY0EI.19.48.E04.1.454.CMB.2.raw
  modified_base (256)..(256): a, c, t, g, unknown or other
  misc_feature (256)..(256): n is a, c, g, or t
  modified_base (559)..(559): a, c, t, g, unknown or other
  misc_feature (559)..(559): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttctcgttggtatttagaaggtgtcagtgtgaggtgcacctggtggagtcgtgggggagcttggtcagccgtgggggtccctgagactctcctgtacnggctcgtgggttctctttagtagttatggatgaacgtcgggcccgcagggcgtccgggggaaggggccggaggtggggtggaccaaacataaagtgacaaagagtaggaaactagaaagaaaaaactagtacggggtaacttcgtggtggaaacggggccgtaatttaccaacctattcctaccaaaggaacgaaacccgaaaacccggttaaaagaaacctttaacgtttaggtttacctaggaactaaaatacggaaactagaccctaggaaacggagacccgggaagggaccaaccgggnttaggttagttatttaaggttggtaggacggaaaagggggctaagggttcgggacgttagggggactaggtcgggacggtcgtacgggggaaccaaaacgggggaccaccgggtacccaccggttccc

SEQ ID NO: 343722 - DNA, 544 bp, Homo sapiens
  misc_feature: GZ8MTXP02HG6AM.19.48.E04.1.454.CMB.2.raw
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataaatgcaaagatggaactgaagaaaaactagtggggactcgtgtgaagggccattcaccatctccagagacaacgtaagaacttatgtttcngacaaatgaaacagcctgagagccgaggacacggntgtgtattatgtgcgaaggcagtggctgggacagtggacgtcgtgggggaccaagggccacgggtcaccggtcc

SEQ ID NO: 343723 - DNA, 559 bp, Homo sapiens
  misc_feature: GZ8MTXP02IEVG8.19.48.E04.1.454.CMB.2.raw
  modified_base (485)..(485): a, c, t, g, unknown or other
  misc_feature (485)..(485): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttgggtccagcctggggggtccctgagactctcctgtacaggctctgggttctctttagtagttattggatgactgggtccgccagggcgtccgggggaaggggccggaggtggggtggccaacataagtgcaaagatggaactgaagaaaaactagtaggggactcgtgtggaagggccgattcaccatctccagagaccaaacgtaagaaacttacttgtttctgacaaaatgaacagcctagagagccgaggacaccggntagtgtattatgtgcggaaggcaggtggcgtgggacagtggacgtgtcggggacaagggaccacggtcaccgtc

SEQ ID NO: 343724 - DNA, 606 bp, Homo sapiens
  misc_feature: GZ8MTXP02I586X.19.48.E04.1.454.CMB.2.raw
  modified_base (261)..(261): a, c, t, g, unknown or other
  misc_feature (261)..(261): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
  modified_base (543)..(543): a, c, t, g, unknown or other
  misc_feature (543)..(543): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattgggtctgagctgggttttcctgttggtattttagaaggtgtccagtgtgaggtgcacctggtggagtcgtgggggagcttggtccaggccgtggggggtccctgagactctcctgtacnggctcgtgggttctcctttagtagttattggatgaacgtgggccccgcgaggctccgggggaaggggccggaggtggggtggccaaacataaatgacaaagntaggaactgaaagaaaaactgtaggggactcgtgtggaaacgggcgattccaccatccacaganaaccaacgtaaagacttattgttctagtacaaatagaaacagcctaggaacgacgacccggaaggaaccacgggcttggtagttaattagttgaggcggaaaggggcaaggtcggngtacggggactagtggacgtcggcggggacccgaaaacggggcctaacgggtccacggttccc

SEQ ID NO: 343725 - DNA, 550 bp, Homo sapiens
  misc_feature: GZ8MTXP02G702Q.19.48.E04.1.454.CMB.2.raw
  modified_base (435)..(435): a, c, t, g, unknown or other
  misc_feature (435)..(435): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctggggggtccctgagactctcctgtacaggctctgggttctcctttagtagttattggatgaactggcccgcaggctccggggaagggccggagtgggtggccaacataatgcaagatggaactgaagaaaaactagtaggggactcgtgtggaaggggccgattcaccatctccagagacaaccgtaagaacttactgtttcngacaaatgaacagcctagagagccgaggacacggctgtgtattagttgtgcggaagggcaggtggcgtgggacagtggacgtgtcggggaccgaagggccacgggtccaccgtcc

SEQ ID NO: 343726 - DNA, 675 bp, Homo sapiens
  misc_feature: GZ8MTXP02JCV1D.19.48.E04.1.454.CMB.2.raw
  modified_base (262)..(262): a, c, t, g, unknown or other
  misc_feature (262)..(262): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtgggggtccctgagactctcctgtacnggctcgtggttctcttagtagttatgatgacgtcggcccgcaggcgtccgggggaagggccggaggtgggtggaccaacgataagtgacaaagagtaggaactagaaagaaaaacgtagtaggggactcgtagtgggaacgggccgtaattccaacctactcctacccgaaagaaccgaaacccgtaaaaccgtaaagttaaacctttacgttagtttacgtacgtaaactaaaagtacgaaacgacgtaccgtaaggacgaccggaccggacgggaaccgtacgggtcttaggttagttaatttagttgggtacgacggaagggtcgagggtcgggacgtagggacgtaggtcgggtacggtcgggtacgggggaccgaaacggggaccgtaccggttaccaccggttcccg

SEQ ID NO: 343727 - DNA, 737 bp, Homo sapiens
  misc_feature: GZ8MTXP02F1WX0.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctcgtgggttctcctttagtagttatggatgaactgggccccgcaggcgtccggggaaggggccggagtgggtggccaacataaatgacaaagataggaactgaaagaaaaaactagtaggggactctaggtaggaacggggccgtaattccaaccctaatcctacccgaaagaacggaaaccctaaaaccggtaaaagtaaacctttaacgttacgtttaccgtaggtacctaaaaagtacggaaaactaaacggacccgttaggaaacggacggaccccggaaaggggaaccaaaccgggggtctaggttaggttaaacttttaggttacggtaggaccggtaaaagggggtccaaagggttgggaccgttacgggggaactaaacggtggggtaaacccgggtcggtacggggggaccccgaaaaacgggggacccctaaccgggggtaccctaaacccgggtttcccccg

SEQ ID NO: 343728 - DNA, 680 bp, Homo sapiens
  misc_feature: GZ8MTXP02HESAR.19.48.E04.1.454.CMB.2.raw
  modified_base (301)..(301): a, c, t, g, unknown or other
  misc_feature (301)..(301): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggaggcttggtccagccgtgggggtccctgagactctcctgtacaggctcgtggttctcttagtagttatggatgacgtgggcccncgaggcgtccggggaagggccggaggtgggtggccaacataatgacaaagagtaggaactgaaagaaaaactagtaggggacttcgtggtggaaacggggccgtattccaacctatcctacccgaagaacgaaaccgaaacccgttaaagtaaacctttacgttcgtttactagactaaaagtagaaacagacccgtaggacggacgacccgggaacgggaaccgaccggtcgttaggtagtttatttaagttcgggtaggaccggtaaaggggcgtaagggtcggggacgtagggggaccgtaaggtcggggaaccggttcgggtacgggggacccgaaacgggggacccgtaccgggtacccgaacccggttccccg

SEQ ID NO: 343729 - DNA, 643 bp, Homo sapiens
  misc_feature: GZ8MTXP02F2AOO.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctcctttagtagttattggatgaactgggccccgccaggcgtccgggggaaggggccggaggtggggtggccaacataatggacaaagatggaactgaaagaaaaactagtggggaactcgtagtgggaaacgggccgtaagttccaaccaatcctaccaagacgaacaaaccgtaaagaaacctttactgtttactagaacaaaatacgaaacagtacctaggaagagcccgaagggaccacgggctagtagttattagttggtaggacggtaagggggcaagggtcggacgttggggaacctaggtgggaaccgtcggtacgggggaccgaaaacgggggaccctaacggggtccaacccggttccc

SEQ ID NO: 343730 - DNA, 740 bp, Homo sapiens
  misc_feature: GZ8MTXP02HVOFO.19.48.E04.1.454.CMB.2.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgagtgcactggtggagtcgtgggggagcttggtccgagccgtgggggtccctggagactctcctgtacnggctntgggttctcttagtagttattggatgacgtcgggcccgcgaggccggtaccgggggaagggccggaggtggggtcggaccaaactaagtaaagtgacgaaaggtatagggaaactaggaaaagaaaaaacgtgtagggggtacttacggtggttagggaaacggggtaccgtacgttacccgaacctacgtacctaccgaaagaacgaaaccgtaaaacccggttaaaacgtaaaccctttacgtttacgttttacgtacgaaactaaaaagtcgaaaacgacgacccgttaggaaacggacggaacccggtaacggggaaccgacgggtacgttagttaggtttaaatttaagtttggtaaggaccgggtaaaagggcgtaagggtcggacggttaggggaactaggtcggaacggttcggtacgggggaaccgtaaaacgggggaccctaaccgggttaccgtaacccgtcccg

SEQ ID NO: 343731 - DNA, 582 bp, Homo sapiens
  misc_feature: GZ8MTXP02HQYZ4.19.48.E04.1.454.CMB.2.raw
  modified_base (450)..(450): a, c, t, g, unknown or other
  misc_feature (450)..(450): n is a, c, g, or t
  modified_base (491)..(491): a, c, t, g, unknown or other
  misc_feature (491)..(491): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctcgtgggttctcctttagtagttatggatgaactgggcccgccaggcgtccgggggaagggccggaggtggggtggaccaacataaatgacaagatggaactgaagaaaaactgtaggggactcgtgtggaaagggccgattccaccatctccagacgaccaaacgtaaagaacttacttgtttcngacaaagtgaaacagcctagagagcgaggacacggctagtntattatgtgacggaagggcaggtcggcgtagggacacggtggacgtcggtacggggaccgtaacggggacctacgggtccaccggttcccg

SEQ ID NO: 343732 - DNA, 559 bp, Homo sapiens
  misc_feature: GZ8MTXP02IXQVP.19.48.E04.1.454.CMB.2.raw
  modified_base (408)..(408): a, c, t, g, unknown or other
  misc_feature (408)..(408): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggaggcttggtccagccgtgggggtccctgagactctcctgtacaggctctgggttctcctttagtagttattggatgaactggcccgccaggcgtcggggaagggccggagtgggtggccaacataatgacaagatggaactagaagaaaaactagtaggggactcgtgtggaaagggccgattcaccatcnccagagacaaaccgtaagaacttacgtgtttcagacaaatgaacagcctgagagccgaggacacggctgtgtattatgtgcggaaggcaggtggcgtggggacagtggacggtcgtacgggggaccaaaggggccacgggtcaccggttcc

SEQ ID NO: 343733 - DNA, 628 bp, Homo sapiens
  misc_feature: GZ8MTXP02IU4E4.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccaggccgtggggggtccctgagactctcctgtacaggctctgggttctcctttagtagttattggatgaactgggccccgccgaggcgtccgggggaaggggccggaggtggggtggaccaacataatgacaagataggaactagaagaaaaacgtagtaggggactcgtgtggaagggccgattccacctatctaccagacgaacaaaccgtaaagtaacttacttagtttctagactaaaatacgaacgaacgccgttaggaacggacgacccgggaggaaccgaccgggtctggttagtaatttagttggtagacggaaggggctagggtcgggacgtggggacagtcgggacggtcggtacgggggaccgaaaggggacccacgggtccaccggtcc

SEQ ID NO: 343734 - DNA, 792 bp, Homo sapiens
  misc_feature: GZ8MTXP02IZHDU.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacnggctctgggttctctttagtagttatggatgaacgtcgggcccgccgaggccgtccgggggaaggggcccggaggtcggggtggaccaaacgattaaatcggacaaagtataggaaactaggaaagaaaaaccttagtaggggaacttcgttagggtacgggaacggggacccgtaatttacccgaacccgtaagtcccgttaacccgaacggaaacggaaacccgtaaaaacccggttaaaacggtaaacctttttaaacccgttacgtttttaccgtacggtaaacctaaaagttacgggaaaaccacgggtacccgttaagggaacgggtaacggacccgggtaagggaaacccgaaccggggtccgtttaggtagttttaaagtttacggtttgggtacggacgggaaaagggggtccgttaaaggggttgggaccggttaggggtaccgtaagggtcgggtaacggttccggggtcgggggaaccgtaaacgggggacccgaccgggttaccctaccgggtttcccg

SEQ ID NO: 343735 - DNA, 594 bp, Homo sapiens
  misc_feature: GZ8MTXP02HI3NN.19.48.E04.1.454.CMB.2.raw
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgagactctcctgtacaggctcgtgggttctctttagtagttatggatgaactgggcccgcgaggcgtccgggggaaggggccggaggtgggtggaccaacataaatgacaaagagtggaactaggaaagaaaaactgtaggggactcgtgtggaaacgggcgattacaccatcctacagagaaccaaacgtaagtaacttactgtttcagacaaatacgaacacgacgtaggagacgaccgaggacgacgngtgtagtattagtgtgacggtaagggngacggtggcgtagggacagtcggacgtcggacgggggaccgacggggaccgacggtccgaaccgtcccg

SEQ ID NO: 343736 - DNA, 607 bp, Homo sapiens
  misc_feature: GZ8MTXP02GLS5C.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtcccctgagactctcctgtacaggctctgggttctcctttagtagttattggatgaactgggccccgccgaggcgtccgggggaaggggccggaggtgggtggccaacataatgacaagatggaactagaagaaaaactagtaggggactcgtgtggaagggccgtagttcaccagtcctacccagaacgaaccaaaccgtaaagaactttactgtttacagtaacaaatacgaacagccgtagagacgccgaggacacggctgtgttaattagttgtagacggaagggcaggtcggcggtaggggactaggtcgggacgtcggtacggggaccgaaacggggacccgacggtccaccggttcccg

SEQ ID NO: 343737 - DNA, 551 bp, Homo sapiens
  misc_feature: GZ8MTXP02IF912.19.48.E04.1.454.CMB.2.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctgggggtccctgagactctcctgtacnggctctgggttctctttagtagttattggatgaactgggcccncaggctccggggaagggccggaggtgggtggccaacataatgcaaagatggaactgaaagaaaactagtggggactctgtggaagggcgattcaccatctccaaganacaaaccgtagaaacttctgtttctgacaaaatgaacagcctgagagccgaggacacggctgtgtattatgtagcgaagggcaggtggcgtagggacagtggacgtcgtagggggaccaaaggggcccacggctaccgacccg

SEQ ID NO: 343738 - DNA, 568 bp, Homo sapiens
  misc_feature: GZ8MTXP02HK6I0.19.48.E04.1.454.CMB.2.raw
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctccttagtagttattggatgaactgggccccgccaggccgtccgggggaaggggccggaggtgggtggccaacataaatgcaaagatggaactgaagaaaaactagtggggactcgtgtggaaggggccgattccaccatctccaganaccaacgtaagaacttactgtttcngacaaatgaacagcctagagagccgaggacacggctgtgtattagtgtgcgaagggtcaggtcggcgtggggacagtgggacgtcggtggggaccaaacggggcccacgggtccaccggtcc

SEQ ID NO: 343739 - DNA, 571 bp, Homo sapiens
  misc_feature: GZ8MTXP02H4JA6.19.48.E04.1.454.CMB.2.raw
  modified_base (307)..(307): a, c, t, g, unknown or other
  misc_feature (307)..(307): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtgggttttcctcgttggtattttagaaggtgtcagtgtgaggtgcacctggtggagtcgtgggggagcttggtccagccgtggggggtccctggagactctcctgtacaggctctggggttctcctttagtagttattggatgaactgggcccnccgaggcgtccgggggaagggccggaggtgggtggaccaaacataaatgacaaagataggaactgaaagaaaaaactgtaggggactcgtggtgaaaggggccattcaaccatcctaccaagagaacaaaccgtaaagaacttactagtttcagacaaatgaaacagcctagagagaccgaggactacggctgtagtattattgagacgaagggnaggcgngacgacgagtgacgtcgcggacggacggacgacgacgacgtcg

SEQ ID NO: 343740 - DNA, 681 bp, Homo sapiens
  misc_feature: GZ8MTXP02JXGS1.19.48.E04.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctggtttcctcgttggtattttagaaggtgtccagtgtgaggtgcacctgggtggagtctgggggagcttgggtccagccgtggggggtccctgagctctcctgtacgngctcgtggtctcttagtagtntgntgacgtcggccgcgnggcggcggggagggcggnggtggngacagatanganaagagtaggaactagaaagaaaagtagtaggggtactgtaggtcggaacgggaccgtattaccgactactcctaccgaagaacgaaaccgtaaacgtaaacgtaactttacgttgttacctagtaaactaaagtacgaacgtacgccgtagggacgaccggaccgggtaaggaccgtaccgggtcttacggttagttaagtttaggtcgggtacgggaacggtaacgggggacgtagggtacgggtacgggtacgggtacggtacggtacgggtaccgggtaacgggtaccggggtaaccgggtaaaccgggtaacccggtaccggtacccggtacccggtacccg

SEQ ID NO: 343741 - DNA, 631 bp, Homo sapiens
  misc_feature: GZ8MTXP02JP762.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttatggatgaactgggcccgcaggctccggggaagggccggagtgggtgccaacataatgcaagataggaactgaaagaaaaactagtaggggactcgtgtgggaaaggggccgattaccgacctaagtcctacccgaagaacgaaaccaaaccggtaaagtaaactttaactgtttacctagtaaccaaaatacgaaaacagccgtagaacggacgacccggaagggacctacggcttggtagtaattattggtgacggaagggcagggtggacgtaggggactaggtacgggtacggtcgtacgggggaccgaaagggggaccctacgggtaccaccggttcccg

SEQ ID NO: 343742 - DNA, 743 bp, Homo sapiens
  misc_feature: GZ8MTXP02H2I3C.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttttcctcgttggtattttagaaggtgtccagtgtgagtgcacctggtggagtctgggggagcttggtccagccgtgggggtccctgagactctcctgtacaggctctgggttctcctttagtagttattggatgaactgggcccgccgaggcgtccgggggaagggccggaggtggggtcggccaaacgataaactgacgaaagagtaggaactgaaagaaaaactagtaggggactacgtggtgaaacggggccgaatttccgaaccctagtcctacccaagtaacgaaaccgtaaaacccgttaaagtaaaccttacgttttaggtttttaccagacctaaaagttcgaaaacacggacccttaggaaacggacggacccggaagggacccgttaaggggccgttaggtttacggttaattttaaggtttggttacggaaccggggtaaaacgggggcctaacggggttcggaccgggttaacgggggtaaccaacgttcgggggtaaccggttcggtccggggggtaaacccaaacggggggaccccctaaccgggggtttacccaaccccgggtttccccg

SEQ ID NO: 343743 - DNA, 579 bp, Homo sapiens
  misc_feature: GZ8MTXP02I7XXM.19.48.E04.1.454.CMB.2.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (478)..(478): a, c, t, g, unknown or other
  misc_feature (478)..(478): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtcgtgggggaggcttggtccagccgtggggggtccctgagactctctgtacaggctctgggttctccttagtagttattggattaacgtgggccccgcaggcgtccggggaaggggccggaggtggggtggccaacataatgacaagatggaaactgaagaaaactgtaggggactcgtagtgaggggccattcaccntctccagagacaaacgtaanaacttactgttcngacaaatgaaacngcctgagacgcgaggacacggctggnttattagtgtgacgaagggcaggtggcgtaggggactaggtcgggacgtcggtaacgggggcccgaaaacgggggcccacgggtccacccggtctaccccg

SEQ ID NO: 343744 - DNA, 610 bp, Homo sapiens
  misc_feature: GZ8MTXP02H5QPX.19.48.E04.1.454.CMB.2.raw
  modified_base (352)..(352): a, c, t, g, unknown or other
  misc_feature (352)..(352): n is a, c, g, or t
  modified_base (444)..(444): a, c, t, g, unknown or other
  misc_feature (444)..(444): n is a, c, g, or t
tcagtactctcgtgcacgaccggtgctcgatttagagagcgtcacagagagaagggggtctcagagaggagccttagccctggactccaagacctttccacttggtgatcagcactgagcacagacgactcaccatggaattggggctgagcgtgggttttccgtcgttaggtattttagaaggttgtccagtgtgaggtgcacctggtggagtcgtgggggagcttggtccagccgtgggggtccccagactctcctgtacaggctctggttctcttagagttatggatgaactggccccgcaggcgtccggggaaggggccggagtgggtggccaacataaatgcaaagntaggaaactggaagaaaaactagtaggggaactcgtggtaggaggggccgaattccgaccatctaccagacgacaaaccgtaagaacttacngtttactcgacaaatagaacagaccgtagagacgcccgaggacgaccggtgtagttagttagttagttggagacgggaaggcgtaggtacggcgtacgggacgtacggtcggtacgtcggaacggggaccgaacgggacccgtacggtaccgtaccgtaccgtccg

SEQ ID NO: 343745 - DNA, 669 bp, Homo sapiens
  misc_feature: GZ8MTXP02IQ3FD.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtcctgagctctcctgtacaggctcgtggttctcttagtagttatggatgaacgtcgggcccgccgaggcgtccgggggaaggggccggaggtggggtcggaccaacataatgcaaagataggaactaggaagaaaactagtggggacttcgtggtcggaacgggtccgtacttcgaacctagttcctacccgaagaacgtaaacccgtaaaacccgttaaaacggtaccttttaacgtacggttttacttacggaaacctaaagttacggaaacacggtccgtaaggcggaacgccgggtaacgggaaccgcggtacttggttagtagtttagttgggtacgacgggtaaggggcgtaggtcggcggtacgggactaggtcgggtacggtcggacggggacgaacggggaccaccgggtcaccggttccc

SEQ ID NO: 343746 - DNA, 686 bp, Homo sapiens
  misc_feature: GZ8MTXP02IDYH5.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctgggtggagtcgtgggggagcttggtccagccgtggggggtccctggagactctcctgtacaggtctcgtgggttctccgttagtagttatggatgaacgtcgggccccgcgaggcgtccgggggaggggccggaggtggggtggaccaaacgataaagtgacaaagagtaggaactagaagaaaaaactgaggggacttcgtgtggaaacgggcgattccacctatctcccgaagtacgaaccaaaccgtaagtaaacctttacttacggtttacagtaacctaaaagtcggaaacacggtacccttaggaacggtacggaccgggaagggaccgaccgggtacgttaggttagttaagtttagttacgggtagacgggtaaagggtcgtagggtggtaaccggtggggaacctacgggttcggacggtcgggtacgggggacccgtaaacgggggacccgtaccgggtcctaacccgggtcccg

SEQ ID NO: 343747 - DNA, 837 bp, Homo sapiens
  misc_feature: GZ8MTXP02GT5HT.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctcctttagtagttattggatgaacgtcgggccccgccgagggccgtccggggggaaggggcccggaggtcggggtcggacccaaacattaaagtggaccaaaaggagtagggaaacctaggaaaagaaaaaaccgttggtacgggggtaacttcgttagggtagggaaacgggggtcccgtatttaccgaaccctaattcctacccgaaagaacgaaacccgtaaaacccgttaaagtaaacctttaccgttagtttttaccacggtaaacctaaaagttcgaaaaccgtacggtaccccgttagggaacggaacgggaccccgggaaaggggaaccccgtaaacccggggtcgtttaggtttaacggtttaaactttttaaggtttcgggggttaaagggaacccgggggttaaaaacggggggccctaaagggggtttccgggggaccggttaacggggggaacctaaggtttcgggggaaccggtttccgggtaacggggggaaaccccgtaaaacgggggacccccgtaaccggggttcccgtaaccccgggtttccccg

SEQ ID NO: 343748 - DNA, 691 bp, Homo sapiens
  misc_feature: GZ8MTXP02HZUQX.19.48.E04.1.454.CMB.2.raw
  modified_base (607)..(607): a, c, t, g, unknown or other
  misc_feature (607)..(607): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgttggttttcctgttggttatttagaggtgtcagtgtgaggtgcacgtggtggagtcggtgggggagtcgttggtccagtccggtcgggggtccctggacgtacctctcctgtacgaggtctcgttgggttcttcgtttagtagttagtggatgacgtcggcccgcgaggccgtacgggggagggccggaggtgggcgaccaacataagtgacaagagtaggaactagaaaagtaaaaacgtggtacggggacttcggtaggtagggaacggggcctacgttcccaacctactcctaccgaaagaacgaaacccgtaaaccgtaaagtaaacctttagtttacgtttccaagtaacaaaagtacgaaacgacgtccgtaggaacggacggacccggaagggaaccgacggtcgttaggtttagttaatttaggttggaggaacgggtaacggggngtagggtcggacggtaggacgtacggtcggacggtcggggacggggaaccggtaaacgggaccgtaccggtaccgtacccgtcc

SEQ ID NO: 343749 - DNA, 712 bp, Homo sapiens
  misc_feature: GZ8MTXP02F82MY.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtggttctcctttagtagttattggatgaacgtcgggccccgccgaggccgtccgggggaaggggccggaggtgggtcggaccaaacataatgacaaagagtaggaactagaaagaaaaactagtaggggactcgtaggtgggaacgggccgtattccaaccatcctaccgaagacgaaaccgtaaaccgtaaacgtaactttaacgttcgtttactagaactaaaagtacgaaacacggtacctaggaacggacggacccggaagggaacccgaccggtcgttaggttagtttaagtttagttggtacgggaccgggaaaaggggtcgaaggggttcgggacggttacgggggaacgtaagggtcggggtaacgggttccggggtacgggggaacccggtaaaacgggggaccccgtacggggtaccccgtaacccggtttccccg

SEQ ID NO: 343750 - DNA, 713 bp, Homo sapiens
  misc_feature: GZ8MTXP02JVX4Z.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagtcttgggttttcctcggttggtattttagaaggtgtccagtgtgaggtgcaccgtggtggagtcggtgggggaggtcgttgggtccgaggtcccggttcgggggggtcccctggacgtaccttcctcctgtacagggtccttcgtgggttccttccgtttagtagttatggatgacgtcgggcccgcgaggccgtaccgggggaagggccggaggtggggtcggaccaaacgataagtgacaaagagtaggaactagaaagaaaaactgaggggtactcgtggaggaacgggccgtattccgaacctatcctacccgaagaacgaaacctaaaccgtaaagtaacctttacttgtttaccaggtaactaaaatcgtaaacaacggtctaggaaggacgacccggaagggaacctacgggtcttaggttagttagtttaggttggacgaacgggtaaggggcgtaggggtcggaacggtcgggaagtagggtcggggtaacggtccgggtacgggggaacccgtaacggggtacccgtacccgggtaccgaccccggttcccg

SEQ ID NO: 343751 - DNA, 601 bp, Homo sapiens
  misc_feature: GZ8MTXP02J2JL4.19.48.E04.1.454.CMB.2.raw
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgacgactctcctgtacaggctctggttctcttagtagttatggatgaactcgggcccgcaggcgtccgggggaaggggccggaggtgggtggccaacataagtgcaaagatggaactagaagaaaactagtaggggactcgtgtggaagggccgattcaccatctccagacgaacaaaccgtaaagtaacttactgtttacngactaaatagaacatacngacgagacgagggacacggcttagtagttattagttgacgacggaagggcgtaaggggcggtcggtacgggacgtacgtacggtacggtcggtacggggaccggacgggaccggtaccggtaccgtaccgtccg

SEQ ID NO: 343752 - DNA, 632 bp, Homo sapiens
  misc_feature: GZ8MTXP02F9M56.19.48.E04.1.454.CMB.2.raw
  modified_base (259)..(259): a, c, t, g, unknown or other
  misc_feature (259)..(259): n is a, c, g, or t
  modified_base (470)..(470): a, c, t, g, unknown or other
  misc_feature (470)..(470): n is a, c, g, or t
  modified_base (541)..(541): a, c, t, g, unknown or other
  misc_feature (541)..(541): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtcgtgggggagcttggtccagccgtgggggtccctgagactctcctgtacnggctctgggttctcctttagtagttatggatgaactggcccgcaggctccggggaaggccggagtgggtgccaaacataaatgacaaagagtagggaaactaggaaagaaaaaacgtagtacgggggtaactcgttaggtagggaaacggggcccggtaatttaccaaccctaattcctacccgaaagaacgaaccaaaacccggtaaaanaaacctttaaccgttagtttcctagaacaaaatacgaacaaaggcctagaagagcccgaagggacacggtntgtatattagtgtgaggaggcgaggtcgacgtaggactagtcggtacgtcggtacggggaccgaacgggacccgtacggtaccgaccgtcc

SEQ ID NO: 343753 - DNA, 577 bp, Homo sapiens
  misc_feature: GZ8MTXP02JIJ85.19.48.E04.1.454.CMB.2.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtggggggagcttgggtccaggccgtggggggtccctggagactctcctgtacnggctctgggttctcctttagtagttatggatgaactcgggcccnccgaggcgtccgggggaaggggccggagtggggtggccaaanataaatgacaagataggactgaagaaaaactgtaggggacttcgngtgaagggcgattcaccatcncaaganaacaaaccgtaagaacttactgttcngacaaatgaacagcctgagngaccgagaactcggntgtatattgtgagaggaaggngaggtcggacgtacggacgngtacggtacggtcggtacggggaacgaacgggacctacggacctaccgtcg

SEQ ID NO: 343754 - DNA, 703 bp, Homo sapiens
  misc_feature: GZ8MTXP02JHQ3Z.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcgttggtccagccgtgggggtccctgagactctcctgtacnggctcgtggttctcttagtagttatggatgactgggcccgccgaggccgtccgggggaaggggccggaggtggggtcggccaacataagtgacaagatggaactgaagaaaaactgtaggggactcgtggtaggaacggggcccgtaattccaaccgtattcctacccgaaaggaacgaaaccctaaaacccgggttaaagtaaaccctttaacgttcggttttactacggtaacctaaaagtcggaaaaccacggtacccgttaagggaacggaacggacccgggaacgggaaccgaccggggtcgttagggttacgtttaaagtttagttgggttaggacggtaaaacggggcgtagggtcggcgttaggggactaagtcgggtaacgtcggtacgggggacccgaaacgggggacccgtacgggtaccgtaccgttcccg

SEQ ID NO: 343755 - DNA, 753 bp, Homo sapiens
  misc_feature: GZ8MTXP02I621J.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtgggttctccttagtagttatggatgaacgtcgggcccgccgaggcgtccgggggaaggggccggaggtgggtggccaaacataatgacgaaagagtaggaactaggaaagaaaaaacgtagtaggggtactacgtaggtagggaaacggggtccgtaagtttaccaacctaactaccgtacccgaaagaaaccgaaaccgtaaaaccgtaaaacggtaaacctttaacgttacgttttacctacggtaacctaaaagttacggaaaactaacgcccgttaaggaacgaaccggacccggaagggaacccgaacggtccgttagtagttaagtttagtttacggtaggaacggtaaaggggcgtaaagggtgggtaccgtagggggtaaccaaggtttcggggaaccggtttaaccgggtacgggggtaacccgggaaaacggggtaaccccggtaaccggttaccgtaacccccgggtttccccg

SEQ ID NO: 343756 - DNA, 604 bp, Homo sapiens
  misc_feature: GZ8MTXP02F774R.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctctttagtagttattggatgaacgtgggccccgcaggcgtccgggggaaggggccggaggtggggtggccaaacataaagtgacaaagataggaactagaaagaaaaactagtggggactcgtgtggaacgggccgattccaccatctccaagagaaccaaaccgtaaagaacttactgtttctgactaaatacgaacagcctagaggacgccggaaggacacggctagtgttattagtggtgacggtaagggcagggtcggacgtggggacagtggggacgtcggtacgggggaccgaaacgggggaccctaacgggtccaaccgttcc

SEQ ID NO: 343757 - DNA, 702 bp, Homo sapiens
  misc_feature: GZ8MTXP02GF1QX.19.48.E04.1.454.CMB.2.raw
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtcagtgtgaggtgcacctggtggagtcgtgggggagcttggtccaggccgtgggggtccctgagactctctgtacaggctgtgggttctctttagtagttatggattgaactgggcccncgaggcgtcggggaagggccggagtgggtggccaanataatgacaaagagtaggaaactgaaagaaaaactgtaggggactcgtgtagggaacggggtccctaagttccaacctaagttcctacccgaaaggaaacgaaacccgtaaaaacccggtaaaagtaaaccttttaacgttacggttttacctaaggtaaccctaaaagtaacgaaaactaaacggacccgttaggaaacggacgggacccggaaaggggaacccgaacgggtcgtaggttagttaagtttaagttgggtacgacgggaaaagggtcaggggttacggcggtagggacgaagttcggggacgtcgggtcgggggaaccgaaacggggacccaaaccggggtccaacccgttcccg

SEQ ID NO: 343758 - DNA, 635 bp, Homo sapiens
  misc_feature: GZ8MTXP02IYVCG.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgagactctcctgtacnggctcgtgggttctccttagtagttatggatgaactgggcccgccaggcgtccggggaagggccggaggtgggtggccaacataagtgacaagataggaactagaagaaaaactagtacggggactcgtaggtggaagggccgattaccaccatctcccagacgaccgaaaccgtaaagtaactttacttgtttactagtacaaatacgaaacagccctagacgagaccgagggaaccacggcttggtagttaatttagttgtggacggtaacggggcagggtcgggcgtagggtacgaaggttcgggacggttccggtcgggggaaccccgaaacgggggaccccgtaaccgggtccgaacccgtttcccg

SEQ ID NO: 343759 - DNA, 677 bp, Homo sapiens
  misc_feature: GZ8MTXP02H6YDC.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctggagactctcctgtacaggctctgggttctcctttagtagttattggatgaactgggccccgccgagggccgtccggggggaaggggcccgggaggtggggtcggaccaaacgataaactgacaaaggatagggaactgaaagaaaaactagtaggggactcgtaggtggaaacggggcgacttccgacctactacctaccaagagaaccaaacccggtaaagtaacttaacgttagttttacctaggtaccaaaattgaaaccacgaccttaggagaacggcccggaagggaccgacggtcgtagttagtatttagttggtgtacggaaagggcgtaaggtcgggcgtaggggaccaggttacgggaccggttcggtcgggggacccggaaacgggggacccgtaaccggggtccgtaacccgttccccg

SEQ ID NO: 343760 - DNA, 609 bp, Homo sapiens
  misc_feature: GZ8MTXP02HXKK3.19.48.E04.1.454.CMB.2.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtncacctggtggagtctgggggaggcttggtccagccgtggggggtccctggagactctcctgtacnggctctgggttctcctttagtagttattggatgaacgtgggccccgccaggccgtccgggggaaggggcccggaggtggggtggaccaacataaatgacaagatggaactgaagaaaaactagtaggggactacgtgtggaagggccgtattccaaccatctacccgagagacaaaccgtaagaacttacttgttctgacaaatagaacagtacctagaggacgccggaggacgacggctaggtgtatttagtgtagcgaagggcgaggtcggcgttagggactagtcggggaacgtcggtacgggggaccgaaaaggggacccgtaccgggtacctacccggttcc

SEQ ID NO: 343761 - DNA, 599 bp, Homo sapiens
  misc_feature: GZ8MTXP02JXNV5.19.48.E04.1.454.CMB.2.raw
  modified_base (523)..(523): a, c, t, g, unknown or other
  misc_feature (523)..(523): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctcctttagtagttattggatgaacgtgggccccgccgaggccgtccgggggaaggggccggagtggggtggaccaacataatgacaaagatggaactgaagaaaactgtggggactcgtgtggaaacgggcgattccacatctccaagacgaacaaaccgtaagaacttactgttctgacaaagtgaaacagcctagagacgccgagggacacggctgtgttattagttgtgacggtaagggctaggnggacgtaggggacaggtcggaaccggttcggacgggggacccgaaaggggccccgacgggttccgacccgtttccg

SEQ ID NO: 343762 - DNA, 664 bp, Homo sapiens
  misc_feature: GZ8MTXP02GYDS6.19.48.E04.1.454.CMB.2.raw
  modified_base (259)..(259): a, c, t, g, unknown or other
  misc_feature (259)..(259): n is a, c, g, or t
  modified_base (504)..(504): a, c, t, g, unknown or other
  misc_feature (504)..(504): n is a, c, g, or t
  modified_base (538)..(538): a, c, t, g, unknown or other
  misc_feature (538)..(538): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctctgtacngctcgtggttctcttagtagttatggatgactgggcccgcgagggcgtccgggggaaggggccggaggtggggtcggaccaaacgattaaacgtgacaaaggatagggaaactaggaaagtaaaaactgtaggggtactcgtaggtggaaacggggcccgtaattccgaacctattccacccgaaagacgaaaccgtaaacccgtaagaaacctttacgttgtttacctaagtaaactagaaacncgacctaggaagacggaccgaagggacaaccggngttagtagttagtttaagttggtaggacggaagggtctagggttcgggacgttaggggaactggtacgggtacgttggaacgggggaccgaaacgggaccgtaccggtacctacccggtctacccg

SEQ ID NO: 343763 - DNA, 749 bp, Homo sapiens
  misc_feature: GZ8MTXP02GPK48.19.48.E04.1.454.CMB.2.raw
  modified_base (307)..(307): a, c, t, g, unknown or other
  misc_feature (307)..(307): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctggagactctcctgtacaggctcgtgggttctcctttagtagttatggatgaacgtgggccccncgaggcgtccggggaaggggccggaggtgggtggccaacataagtgacaaagagtaggaactagaaagaaaaactgtaggggactcgtgtggaacgggtcctaagttccaacctaagtcctacccaagaacgaaacccgtaaaccgtaaagtaaaccgtttacgttaggtttacctaggtaacctaaaagtacgaaaaccgtacggtaccctaagggaacgggaaccggacccgggaaaacgggacccggaaccggggtctttagggttacggtttaaatttaaggtttgggtacgggtaccggggtaaaggggaccgtaacggggttgggtacgggttacggggaccgtaaggttacgggggacgggttccgggtaaccggggggaacccgtaaaccgggggaacccgtacccggggtaacccgtaacccggtttcccccg

SEQ ID NO: 343764 - DNA, 561 bp, Homo sapiens
  misc_feature: GZ8MTXP02I8XTP.19.48.E04.1.454.CMB.2.raw
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttgctcttttaagaggtgtccagtgtcaggtgcagctggtggagtcgtgggggagcggtggtccagccgtgggacgtccctgagactctcctgtgcagcctcgtggattccaccttcaagtagctatggcatgcacgtggggtccncaggcctcgaggacgaggggctggacgtggggtgctagttanatcgatgtgatagggaaataactaaatntatgacagactacggtaggaaacgggcctaattccaactactacctaccgaaagaacgaaactaaacttcccgaaaacgaccgaacgtcttagtacttacgaacacaagtacgaacgacgacgagacgacgacgacgacgacgacgtgtcgtacgtacgtacgtacgtacgacggtacgg

SEQ ID NO: 343765 - DNA, 770 bp, Homo sapiens
  misc_feature: GZ8MTXP02IQQ7F.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctcctttagtagttatggatgaacgtcgggccccgcgaggcgtccgggggaagggccggaggtgggtcggaccaaacataagtgacaaagataggaactaggaaagaaaaactgtaggggactcgtaggtaggaacggggcctaagttaccaacccgtataccgtaccgaaagaacgaaacccgtaaaacccggttaaaaggtaaaccctttaaccgttacggttttacctaggtaacctaaaagttagaaaaccgtaacggtacccgttaggaaacggacggaccccgggaagggaacccgaaccgggtcgtttaggttagtttaatttaagtttgggtacggtaacgggaaaacgggggtccgtaaaggggttcgggaccggttagggggaaccgtaaggttacgggggtaaaccggttccggggtacggggggaaccccggtaaaacgggggacccccgtaaccggggttaccccgtaaccccggtttccccg

SEQ ID NO: 343766 - DNA, 693 bp, Homo sapiens
  misc_feature: GZ8MTXP02G9RJH.19.48.E04.1.454.CMB.2.raw
  modified_base (267)..(267): a, c, t, g, unknown or other
  misc_feature (267)..(267): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggtcgttggtccagccggtgggggtccctggacgactctcctgtacnggctgtggttctcttagtagttatggatgacgtcgggcccgcgaggcgtaccgggggaaggggccggaggtggggtcggaccaaacgtataagtgacaaagtagtagggaactaggaaagtaaaaacgtaggtacggggactcgttagggtgggaaacggggccgtatttacccgaacctaacgtcctacccgaagaacgaaaccctaaaccgtaaagtaaacctttacgttagtttctagtaactaaatcgaaacacgaccgtaggaacggacggacccggaagggaccaccgggtcttggtagttaatttagttggacggacggtaaagggctagggtcggtaccggtagggactaggtacgggtacgtaacgggtcgggggaacccgtaaacggggcccgtaccggtccgtacccggttcccg

SEQ ID NO: 343767 - DNA, 769 bp, Homo sapiens
  misc_feature: GZ8MTXP02H6EHK.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtcgtgggggaggcgttggtccagccgtggggggtccctggagactctccctgtacgaggtctcgtgggttcttccttagtagttattggatgaacgtcggccccgcgaggccgtccgggggaggggccggaggtggggtcggaccaaacgagtaaagtggacaaagagtaggaaacgtaggaaaagtaaaaaacgtgtacgggggtaacttcgtagggttaggaaacgggggtaccctaagtttacccaacccgtactaccctacccgaaagaaaccgaaacccgtaaaacccggttaaacggttaaaacccttacgtttacgtttttaccaacggtaaacccaaaagttaccgaaaacgacgtcccgttaggaacggaacggacccgggaaaggggacccacggggaccttagggttagtttaagtttaagttgggtacggaaccgggtaaagggaccgtaggggtcggacggttagggaacgtaggttacgggtaaccgtccgggtacgggggaaccgaaacgggggtaaccccaccggggtaccctacccggtccccg

SEQ ID NO: 343768 - DNA, 757 bp, Homo sapiens
  misc_feature: GZ8MTXP02ILTNA.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggagcttggtccagccgtgggggtccctgagctctctgtacagctcgtggttctcttagtagttatggatgaacgtcgggccccgccgagggccgtaccgggggaaggggccggagggtggggtcggacccaaacgaagtaagtggacaaagagtaggaacgtaggaaaacgaaaaaacgttaggtacggggtacttcgttagggtaggggaaacggggtcccgtaactttaccgaaccctagttccctacccgaaagaacgaaacccgtaaaacccggtaaaagtaaaccttttacgtttcgtttacctagtaacctaaaagtacgaaacgtacgtaccgtaggaacggacggaccgggaagggaacccgtaccgggtgttaggtttagtttaagtttagtttgggtacgggaaccgggtaaaacggggcgtaaggggtcggggtacggtacggggtacgtaacggttcggggtaccgttaaccggggtcgggggaacccgaaacgggggacccctacgggttacccgtacccggttcccg

SEQ ID NO: 343769 - DNA, 562 bp, Homo sapiens
  misc_feature: GZ8MTXP02I3QUG.19.48.E04.1.454.CMB.2.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (406)..(406): a, c, t, g, unknown or other
  misc_feature (406)..(406): n is a, c, g, or t
  modified_base (535)..(535): a, c, t, g, unknown or other
  misc_feature (535)..(535): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacnggctctgggttctccttagtagttatggatgaactgggcccncagcgtcggggaagggccgaggtggnggcaacataatgacaagatgggaactaggaagaaaaactgtaggggactgtgtggaagggccgattccaaccatccnccgaagacgaacaaacgtaagaaccttacttgtttctagactaaagtgaacagcctagacgacgccgaggaccacggctagtgtattatggtgacggagggcaggtcgcgtagggacagtggacgtcgnggggaccaagggccacggtcaccgtcc

SEQ ID NO: 343770 - DNA, 620 bp, Homo sapiens
  misc_feature: GZ8MTXP02FPLYY.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacaggctctgggttctcctttagtagttattggatgaactgggcccgcaggcgtccgggggaaggggccggaggtggggtggccaacataatgacaaagataggaactgaaagaaaaactagtaggggactcgtgtggaacgggccgtattccgaccatcctaccaagacgaaccaaaccgtaaagtaacctttacgttgtttcctagacctaaagtacgaaacagaccctaggacgacgcccggaaggaccacgggcttggtagttattagttgtggacggaaggggcaggtggacgttaggggacagtcgggacgtcggtcgggggaccaaacgggggaccctacgggtccaccggttcc

SEQ ID NO: 343771 - DNA, 678 bp, Homo sapiens
  misc_feature: GZ8MTXP02IPF6Y.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtgggttttcctcgttggtattttagaaggtgtccagtgtgaggtgcacctggtggagtcgtgggggaggcttggtccagccgtgggggtccctgagactctcctgtacagctcgtggttctccttagtagttatggatgaacgtcgggcccgccgaggccgtccggggggaaggggcccgggtaggtggggtcggacccaaaacgagtaaagtggaccaaagagtaggaactagaaagaaaaactagtaggggacttacgtggtgggaaacggggtccgtaacttccaacctatcctacccgaagacgaaacccgtaaaacccgtaaagaaaccttttaacgttggtttttacctaggtaacctaaaaagtgaaaccagtaccctaggaacgacggacccgggaaggaaccgacgggtctggttagttatttagttggtggacggaagggcgtaggtcgggcgtaggggactaaggtggacggtcggcggggaccgaaacgggccgaccgggtaccacccggtcc

SEQ ID NO: 343772 - DNA, 588 bp, Homo sapiens
  misc_feature: GZ8MTXP02HOSTS.19.48.E04.1.454.CMB.2.raw
  modified_base (444)..(444): a, c, t, g, unknown or other
  misc_feature (444)..(444): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttatggatgactgggcccgccaggcgtccggggaggggccggaggtgggtggccaacataaatgacaagatggaactagaagaaaaactagtaggggactcgtgtggaagggccgattaccacatctccagacaacaaccgtaagaacttactgtttacngacaaatgaaacagccctagaggtagacccgagggaccacggtcctggtagttattattggtgcggaaagggcagtcgggcgtgggactagtacgggacgtcggtggggaccgaaacggggtaccaccgggtccgaccgttccg

SEQ ID NO: 343773 - DNA, 733 bp, Homo sapiens
  misc_feature: GZ8MTXP02FUXHM.19.48.E04.1.454.CMB.2.raw
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacnggctctgggttctccttagtagttatggatgaactgggccccncgaggcgtcggggaagggccggagtgggtggccaacataatgacaaagatggaactgaagaaaaactgtaggggaactcgtaggtggaaacggggcccgtaaagtttcccaacccgtaattccgtacccgaaagacgtaaaccaaaacccggtaaaacgtaaactttacgttagttttaccgtaggaacctaaaagtacgaaacgacggtacccttaggaacggacggaccccgggaagggaaccgaacccgggtcgttagggttaggttaaagttttaacgttggggttacggaacccgggtaaaagggggcctaaaggggttcgggacggttaggggaaccgtaaaggtcggggtaaaccggtcggtacggggggaacccgtaaaaacgggggaccccgtaacggggtacccgtaaccggtttccccg

SEQ ID NO: 343774 - DNA, 639 bp, Homo sapiens
  misc_feature: GZ8MTXP02JCSCE.19.48.E04.1.454.CMB.2.raw
  modified_base (395)..(395): a, c, t, g, unknown or other
  misc_feature (395)..(395): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggtttcgtcgtaggtatttagaaggtgtcagtgtgaggtgcactggtggagtcgtgggggagcttggtccagccgtgggggtccctgagactctcctgtacaggctcgtgggttctcttagtagttatggatgaactcgggcccgcgaggcgtccgggggaaggggccggaggtggggtcggaccaaactagtaatgacgaagataggaactagaaagaaaactagaggggactcgttagnggagggcgtacttccactactccaccgaagacgaaacgtaaaccgaaagtaacctttaagttcgttactacgaactaaagcgaaacaggacctaggacgacgccgaagggaaccgacggtctaggttgttaattagttgggacgagggtacggacggtagggtcggtacggtacggacgtacgggtacggacggtcgggtacggggaacccggaacgggtacccggtaccgttaccgaccgtcc

SEQ ID NO: 343775 - DNA, 717 bp, Homo sapiens
  misc_feature: GZ8MTXP02IBO1L.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgagtgcacctggtggagtcgtgggggagcttggtccagccgtgggggtccctgagactctctgtacaggctctgggttctccttagtagttattgggatgaactggcccgccgaggccgtccgggggaaggggccggaggtggggtggccaacataagtgcaaaggatggaacgtgaaagaaaaacgtagtagggggaacttcgtaggtggaaacggggccgtaacttaccaacctactctacccaacggaagaaaccgaaacccgttaaagaaacctttaacgttacgtttttcacgtaacaaaattacgaaaacacggtcctaggaaggagacccgggaagggaccgaacgggtccttaggttcggttaaaatttttagtcgttaggggaccggttaaaacgggggcgtagggtcgggtacgggtacgggtaacgtacggttacggggaccggttaaccggggttaccgggggaacccggtaaacggggtaaccccggtacccggttaccgtaccccggtacccg

SEQ ID NO: 343776 - DNA, 684 bp, Homo sapiens
  misc_feature: GZ8MTXP02I66MA.19.48.E04.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (554)..(554): a, c, t, g, unknown or other
  misc_feature (554)..(554): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcgttggtccagccgtggggggtccctgagactctctgtacnggctcgtgggttctcttagtagttnttggatgaactgggcccgccgaggccgtccgggggaagggccggaggtgggtggaccaacataagtgacaaagagtaggaactaggaaacgaaaaacgtaggtacggggaactcgttagggtagggaaacggggacccgtaattccaacctactcctaccaagaacgaaaccgtaaacccgtaaagtaaacctttacgttacgtttacctagaactaaaatgaaaacctacggacctaggaacggacgacccggaaggacgaccggngttagtaggttaattagttggtaggacggaaaggggcgtagggtcggagttaggggactaagggttcgggaaccgttcggtacgggggaaccaaacgggggacccgtaaccgggtcccgaccggttcccg

SEQ ID NO: 343777 - DNA, 575 bp, Homo sapiens
  misc_feature: GZ8MTXP02J09C1.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttattggatgaactgggcccgcaggctccggggaaggggccggagtgggtggccaacataatgcaagatggaactgaagaaaactgtggggactcgtgtggaaggggcccaattccgaccatcctccaagtagaccaaaccgtaagaactttactgtttctgacaaatgaaacagcctggagacgtccgaggacacggctgtgtattgtgtgcgaagggtcaggcggtcgagggacagttcgggacgttcggcgggggaccaaacggggacccacgggtaccaccggtcc

SEQ ID NO: 343778 - DNA, 656 bp, Homo sapiens
  misc_feature: GZ8MTXP02FOXZN.19.48.E04.1.454.CMB.2.raw
  modified_base (284)..(284): a, c, t, g, unknown or other
  misc_feature (284)..(284): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctctggggttctcctttagtnttatggatgaactgggcccgcaggctccggggaagggccggtagtgggtggccaacataaatgacaagataggaactggaaagaaaaactagtaggggactcgtaggtggaaacggggcctaagttccaccctaatcctacccgaaagaacgaaaccctaaacccggtaaaacggtaaacctttaacgttagtttccttaggaacctaaaagtacgaaactagacccgtaggaacggacgaccggaagggacctaacgggcttaggttagttaatttagttgtaggacggaagggcaggtggcgtggggaccagtagggacgtcggtcgggggaccgaaacgggggacccgtaacgggtccaccggttcccg

SEQ ID NO: 343779 - DNA, 614 bp, Homo sapiens
  misc_feature: GZ8MTXP02IZA17.19.48.E04.1.454.CMB.2.raw
  modified_base (295)..(295): a, c, t, g, unknown or other
  misc_feature (295)..(295): n is a, c, g, or t
  modified_base (437)..(437): a, c, t, g, unknown or other
  misc_feature (437)..(437): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtcagtgtgaggtgcaccgtggtggagtcgtgggggaggtcttggtccagccggtggggggtccctgagactctctgtacaggctctgggttctcctttagtagttattggntagaacgtcgggccccgccgaggccgtccgggggaagggccggaggtggggtcggaccaacataatgacaaagataggaactgaaagaaaaactgtggggactcgtgtgggaagggccgtattaccacctagtctaccaganaaccgaaacgtaaagtacttactgtttccagtacaaatagaactagctagacgagaccgaggtacacggtctgtagttaattatggtagacggaaggtcaggtggcgtagggactaaggtggccggtcggtacgggggaccgtaaccgggggacctaccggtaccgtacccggttcc

SEQ ID NO: 343780 - DNA, 562 bp, Homo sapiens
  misc_feature: GZ8MTXP02FVXK3.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctctgggttctcctttagtagttattggatgaactgggccccgccaggctccgggggaagggccggagtggggtggccaacataatgacaaagatggaactgaagaaaaactagtggggactcgtgtggaagggccgattcacatctcagagacaacgtaagaacttatgttctgactaaatacgaacagcctagagagcccgagggaccacggctgtgtattagtgtgcgaaggcaggtggctgggacagtgggacgtcggtcggggaccgaacggggccacgggtccacccggtcc

SEQ ID NO: 343781 - DNA, 754 bp, Homo sapiens
  misc_feature: GZ8MTXP02JXP6B.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctctgtacnggctcgtgggttctctttagtagttattggatgaacgtcgggccccgcgaggccgtaccgggggaaggggccggaggtggggtggaccaaacagtaagtgacgaaagagtaggaactaggaaagaaaaacgtaggtcggggaactcgtagggtacgggaaacggggcccgtaagttaccaaccgtacttaccgtaacccgaaggaaacggtaaaacccaaaacccgggtttaaaagtaaacccgttttaacgtttagggttttacccctaggtaaaaccttaaaagtacgaaaaccgtaaacggtcccgtaaagggacggaaccggacccggaaagggaacccacgggtcgttaggttagtattttaagttggtaggaacggggtaacggggtacaggggtcggtcgtagggggactaggtacggggtacggttccggggacgggggacccgtaaaacggggaccccgttaacgggtacccctaccggtttccc

SEQ ID NO: 343782 - DNA, 567 bp, Homo sapiens
  misc_feature: GZ8MTXP02ID6AZ.19.48.E04.1.454.CMB.2.raw
  modified_base (262)..(262): a, c, t, g, unknown or other
  misc_feature (262)..(262): n is a, c, g, or t
  modified_base (455)..(455): a, c, t, g, unknown or other
  misc_feature (455)..(455): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacnggctctgggttctcctttagtagttattggatgaactgggccccgccagggcgtccgggggaaggggccggaggtggggtggccaacataaatgacaaagatggaactgaaagaaaaacgtagtagggggactcgtgtggaaggggccgattccaccatctccagagacaaaccgtaagaacttactgtttcngacaaatgaacagcctagagtagcgaggacacggctgtntattatgtgcggaaggcaggnggcgtgggacagtgacggtgtcggggaccaagggaccgacggtcaccgtccg

SEQ ID NO: 343783 - DNA, 589 bp, Homo sapiens
  misc_feature: GZ8MTXP02HFBGJ.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctccttagtagttattggatgaactgggcccgcaggctccggggaaggggccggagtgggtggccaacataaatgcaaagatggaaactgaaagaaaaaactagtagggggaactcgtgtggaaagggggccgtaatttccaacccaatcctacccaagaacgaaacctaaaaccgtaaagaaacttaactgtttccagtacaaaatgaaacagcctgagagcgaggacacggctgtgtattatgtgcgaagggcaggtggctggggacagtggacgtcgtgggggaccgaaaggggacccacgggtccaccggtcc

SEQ ID NO: 343784 - DNA, 694 bp, Homo sapiens
  misc_feature: GZ8MTXP02JM0NS.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctcgtggttctcttagtagttatggatgaactgggcccgcaggcgtccgggggaagggccggaggtggggtcggccaaacataatgacaagataggaactagaaagaaaaactgtaggggactcgtaggtggaaagggccgtattccgaacctagtcctacccgaagaacgaaacctaaaccgtaaagtaacctttacgttagttttcagacaaaagtcgaaacagcctaggaacgacggacccggaagggaaccacgggccttaggttagttaagtttagttacgggtaggaaccggggtaaaaggggtccgtaaagggtcgggtacggttaggggaaacctaaggtcgggggtaaaccggtccggtacgggggggaaccccgaaaacgggggtaccccgtaaccgggttcccgaacccgggtttccccg

SEQ ID NO: 343785 - DNA, 678 bp, Homo sapiens
  misc_feature: GZ8MTXP02J3LQK.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccaggccgtgggggtccctgagactctcctgtacaggctcgtggttctcttagtagttagtggatgacgtcgggcccgcgaggcgtccgggggaagggccggaggtgggtcggaccaacataagtgacaaagagtacggaaactacggaaaagtaaaaactggtacggggtactcgtaggtcgggaaacggggcccgtattccaacctatacctcccgaaagaaacgaaacctaaacccggtaaagtaactttacttgtttaccagaacaaaagtcgaaacacggctaggaagacgacccggtaagggacctacggcttaggtagtttaattagttgacgggacggtaaaggggcaagggtcgggcgttaggggactaagggttcggggaaccggttcgggtacgggggaaccctaacgggggaccccgtaacgggtccctaccggttcccg

SEQ ID NO: 343786 - DNA, 727 bp, Homo sapiens
  misc_feature: GZ8MTXP02H5XBY.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggagcttggtccagccgtgggggtccctgagactctctgtacaggctcgtggttctctttagtagttattggatgacgtgggccccgcgaggccgtaccgggggaaggggccggaggtggggtggaccaaacataagtgacaagagtaggaactagaaagtaaaaacgtgtacggggtactcggtagtgggaaacgggtccgtattaccaaccctatacctaccgagaacgaaacctaaaccggtaaagtaaaccttacgtttaggttttacctaggaacctaaaagtcgaaacgtacgtacccgtaggaacgacggaccggaacgggaccgaaccggtcgtaggtttagttaagtttagttaggtacgggtaaccggaaagggggtaccgtaggggttcgggaccggttacggggaacgtaggttcggggtaccgggttaacgggtaccgggggaaacccggaaaacgggggtaccccgtaaccggggtttccgaaacccccggtttcccg

SEQ ID NO: 343787 - DNA, 566 bp, Homo sapiens
  misc_feature: GZ8MTXP02JU7G9.19.48.E04.1.454.CMB.2.raw
  modified_base (440)..(440): a, c, t, g, unknown or other
  misc_feature (440)..(440): n is a, c, g, or t
  modified_base (483)..(483): a, c, t, g, unknown or other
  misc_feature (483)..(483): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtgggggtccctgagactctcctgtacaggctctgggttctccttagtagttatggatgaactgggcccgccaggctccggggaagggccggagtggtggccaacataatgacaagatggaactgaagaaaactagtaggggactcgtgtggaacggggccgattcaccatctccaagagaaccaaaccgtaaagacttactgtttcngacaaatgaaacctagcctagagacgccgatacgacgaccggnttgtgtattagttgtgcggaagggcaggtggctggggacagtggaacgtcgtcggggaccaaggggacccacgggtcacccgg

SEQ ID NO: 343788 - DNA, 730 bp, Homo sapiens
  misc_feature: GZ8MTXP02JNXMY.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctcctttagtagttatggatgaacgtgggcccgcaggcgtccggggaaggggccggaggtgggtggccaaacataatgacaaagataggaactagaaagaaaaacgtagtaggggacttcgtggtgggaaacggggccgtattccgaacctaattcctacccgaaggaaacgaaaccctaaaaccggtaaacgtaaacctttaaccgttgtttaccctaggaacctaaaagtacgaaactacgacccgtaggaaacggacgaccccggaagggaaacccgaacgggtccgtttagggttaggtttaattagttttgggacggaaccggtaaagggggcctaaagggggttcgggaccgttagggggaccgtaaggttcgggtaaaccggttcgggtacggggggaaccccgaaaacgggggaccccctaacgggggtacccctaacccggtttccccg

SEQ ID NO: 343789 - DNA, 711 bp, Homo sapiens
  misc_feature: GZ8MTXP02JHNVH.19.48.E04.1.454.CMB.2.raw
  modified_base (552)..(552): a, c, t, g, unknown or other
  misc_feature (552)..(552): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcttgggtccaggccgtggggggtccctggagactctctgtacaggctcgtggttctcttagtagttatggatgacgtcgggcccgccgagggcgtccgggggaaggggccggaggtggggtcggccaaactagtaatgacaaagagtaggaactaggaaagaaaaacgtggtacggggacttacgtaggtgggaacggggccgtaattccgaacctactcctacccaaggaacgaaacctaaaccggtaaagtaacctttacgttgtttaccagacctaaaagtacgaactacggacctaggaacgacggacccggaggaccgaaccggtntaggttagttattagttggtacgagggtaaaggggcgtaagggcgggtacggtacggggtacctaagggttcgggtaacccgggttcgggtacccggggggaacctaaaaccggggggaccccgtaaccgggggttaccccgtacccgggtttcccccg

SEQ ID NO: 343790 - DNA, 762 bp, Homo sapiens
  misc_feature: GZ8MTXP02JJQPC.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctctgtacaggctcgtgggttctccgtttagtagttagtggatgaacgtcgggccccgccgagggccgtaccggggggaaggggcccggggtaggtggggtacggaccgaaacaagttaaagtggacaaaggatacgggaaactggaaaagaaaaacgtagtagggggtactcgttgtaggggaaacgggggcctaacgttaccgaaccctactacccgtacccaaaggtaacccgaaaccctaaaacccggttaaacgtaaccttttaacgttcgtttttaaccgcgtaaactaaaagtacgaaaccaaggcccgttaaggaacggacgacccggagggaacccgaacggtcttagggtgtttaaagtttagttgggtacgaccgggtaaaagggtcgtaagggttgggacgggttacgggacgtaaggtttcggggaaccggttcggggtcgggggaaacccggaaacgggggtaccccctaacggggttacccccgccccgtttaccg

SEQ ID NO: 343791 - DNA, 650 bp, Homo sapiens
  misc_feature: GZ8MTXP02GL8OJ.19.48.E04.1.454.CMB.2.raw
  modified_base (261)..(261): a, c, t, g, unknown or other
  misc_feature (261)..(261): n is a, c, g, or t
  modified_base (394)..(394): a, c, t, g, unknown or other
  misc_feature (394)..(394): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctgagactctcctgtacnggctctgggttctccttagtagttattggatgaactgggccccgcaggcgtccgggggaaggggccggaggtgggtggccaacataaatgacaaagagtggaactagaaagaaaactagtaggggactcgtgnggaacgggccgtattccgacctatcctaccaagacgaaccaaccgtaaagaacttattgtttcagacaaatacgaactagacctaggacgtacggccgaagggaccaacgggtcctaggttggttaatttagttaggtggtaccggaaagggggtcagggtcgggtacgttcgggggactagggttcgggaaacgttccggacgggggaacccgaaacgggggtacccgtaccgggttccgaaccccggtttcccg

SEQ ID NO: 343792 - DNA, 673 bp, Homo sapiens
  misc_feature: GZ8MTXP02GOYFH.19.48.E04.1.454.CMB.2.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (602)..(602): a, c, t, g, unknown or other
  misc_feature (602)..(602): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcttggtccagccgtgggggtccctgagactctcctgtacnggctcgtggttctcctttagtagttattggatgacgtgggccccnccgaggcgtccgggggaaggggccggaggtgggtcggccaaacgataaagtgacaaagagtagggaactaggaaagtaaaaacgtagtacgggggacttcgttagggtacgggaaacggggtccgtaagttaccaaccgtactacctacccgaagaaacgaaacccgtaaaaccgtaaagtaaacctttacttagtttctagaactaaaagtcgaaacacgcctaggaacgacggacccggaagggaccacgggtctaggttgttaatttagtggtagacgggaaggcgtaggtcggngtacgggacgtagcgggaacgtcgggtacggggaccgtaaacggggcccgtaacggtccgtaacccgtccg

SEQ ID NO: 343793 - DNA, 828 bp, Homo sapiens
  misc_feature: GZ8MTXP02JPM9A.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacnggtctctggttctcttagtagttatgatgacgtcggcccgcgaggcgtccggggaagggccggaggtgggtcgaccaaacgagtaaatggacaaagtagtaggaactaggaaagtaaaaaacgtagtacgggggtacttcgtagggtacggggaacggggtacccgtacgtttacccgaaccctacgttaccccgttacccggaaaggtaaacccggtaaacccgtaaaaacccgggttaaaacgttaaaacccgttttaaccgtttacggttttacccgtaaggtaaaccctaaaagttacggaaaaccctacgggtacccgtaaggaaccggaaccgggacccgggtaaacggggaaaccgtacccggggtacgttagggttacggtttaagttttaacggtttgggttacggggaaaccggggtaagggggtaccgttaaggggttcggggtacgggtacgggggtaacgtaacggttcggggtaaaccgggttccgggttaccgggggaaacccggtaaacgggggaccccgtaacccgggtacccgtacccggtttcccccg

SEQ ID NO: 343794 - DNA, 635 bp, Homo sapiens
  misc_feature: GZ8MTXP02GZB7Y.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctctgggttctcctttagtagttatggatgaacgtgggcccgccgaggcgtccggggggaaggggcccggaggtggggtggaccaacgataaagtgacaaagataggaactagaaagaaaaactagtaggggactcgtagtggaagggccgattaccaccatcctccagagaaaccaaaccgtaaagaacttaactgtttactagacaaatagaaacagccgtagagacggacgaggacacggctaggtagttaattagtaggtggacggtaagggacgtaggtcgggtacgaggggtacgtaggtgggtaaccggtcgggtacgggggaacccggaaacggggcccgaaccgggtccgaacccggtttcccg

SEQ ID NO: 343795 - DNA, 811 bp, Homo sapiens
  misc_feature: GZ8MTXP02I4H43.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctcctttagtagttatggatgaactgggccccgccaggcgtccgggggaagggccggaggtgggtggccaacataatgacaaagataggaactgaagaaaaactagtaggggactcgttaggtggaaacggggccggtaattaccaccaattcctacccgaagtaaacgaaacccgtaaaacccggttaaaaggtaaacccttttaaccgtttacggtttttacccgtaggtaaccctaaaaagttacgggaaaacctaacgggtaccccgttaaggaaaccggggtacgggacccccgggaaagggggtaaaccccgaaaccgggggtcctttaggggttaacggtttaaacgttttaacggttttggggtacgggtacccgggggtaaaaacgggggtccgttaaagggggttcgggggtaccggttaagggggaaccgtaaggttcgggggtaaaccggttccgggttaccggggggaacccgtaaaacggggggacccccgtaaccggggttacccgtaaccccgggtttccccg

SEQ ID NO: 343796 - DNA, 763 bp, Homo sapiens
  misc_feature: GZ8MTXP02JEBP3.19.48.E04.1.454.CMB.2.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtattttagaaggtgtccagtgtgaggtgcacctggtggagtcgtgggggagcttggtccagccgtgggggtccctgagactctctgtacnggctntggttctcttagtagttatgatgacgtcggcccgcgaggcgtccgggggagggccggagtgggtcgccaacataaagtgacaagataggaactagaaagaaaaactgtacggggacttcgtggtagggaacgggtccgtaagttccgaaccctagtacctacccgaagaaaccgaaacccgtaaaacccggttaaagtaaaccttttaccgttgtttaccgtagaactaaaagtacgaaaccgtagtacccgtaggaaacggacgacccgggaaggggaacccgaaccgggttaccgttagggttaacgtttaagtttaaggttggttacgggtacccgggaaaagggggtcccgtaaaggggtttccggggaaggtttaccgggggaaacgttaaacggttcgggggtaaccccggttaagggggttacccggggggtaaaccgaaaccggggggttaacccccacccgggggtttaccctaaaccccggtttccccgg

SEQ ID NO: 343797 - DNA, 603 bp, Homo sapiens
  misc_feature: GZ8MTXP02H21AG.19.48.E04.1.454.CMB.2.raw
  modified_base (426)..(426): a, c, t, g, unknown or other
  misc_feature (426)..(426): n is a, c, g, or t
  modified_base (492)..(492): a, c, t, g, unknown or other
  misc_feature (492)..(492): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctggggttctcctttagtagttattggatgaactgggcccgccaggcgtccggggaaggggccggagtgggtggccaacataatgcaagatggaactgaagaaaaactagaggggactcgtgtggaagggccgagttcaccatctccagagacaacgtaanaacttacttagtttctagacaaatagaacaagcccgttagaaggacgccggagggaccgaaccggntagttgttaatttattaggtcgacggaagggcgtaaggtggcgttaggggacagtcggaacgtcgtacgggggaccgaaacggggacccgaacggggtccacccggttccc

SEQ ID NO: 343798 - DNA, 622 bp, Homo sapiens
  misc_feature: GZ8MTXP02GAIAM.19.48.E04.1.454.CMB.2.raw
  modified_base (258)..(258): a, c, t, g, unknown or other
  misc_feature (258)..(258): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagctctctgtacnggctctgggttctctttagtagttatggatgaactcgggcccacagggcgtccgggggaaggggccggagtggggtcgccaacataatggacaaagataggaactagaaagtaaaaactggtcggggactcgtaggtggaacgggtcccaattcccgactatccctaccgaagacgaaccaaaccgtaaagtaacctttatgtttacctagacctaaatagaactacgcctagacgagtcccgaaggaccacggctaggttgttaattagtggtgacggtaaggggcaggtcggacgttggggactaggtcgggacgtcgggtacgggggacctaaaagggggccctacgggtccaccggttcc

SEQ ID NO: 343799 - DNA, 606 bp, Homo sapiens
  misc_feature: GZ8MTXP02H1A5W.19.48.E04.1.454.CMB.2.raw
  modified_base (304)..(304): a, c, t, g, unknown or other
  misc_feature (304)..(304): n is a, c, g, or t
  modified_base (476)..(476): a, c, t, g, unknown or other
  misc_feature (476)..(476): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctggggttctccttagtagttatggatgaactgggcccncgaggctccggggaaggggccggaggtgggtggccaacataaatgacaaagatggaactggaaagaaaaaactgtaggggaacttcgtagtggaaaggggccaagtttccaaccctatcctcccaagacgaacaaaccgtaagaacttacttgtttactgacaaatgaaacngcctgagagaccgaggacacggctgtagtattattggtgacggaaagggcgtaagggtcgacgtggggaacagttagggacggtcggtacgggggaccgaaacggggacccgaccggtcaacccggtccc

SEQ ID NO: 343800 - DNA, 637 bp, Homo sapiens
  misc_feature: GZ8MTXP02JZ88B.19.48.E04.1.454.CMB.2.raw
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctctggttctctttagtagttattggatgaactgggcccgcgaggcgtccgggggaaggggccggaggtgggtggccaacgagtaaatgacaagataggaactgaaagaaaactagtaggggactcgtgtggaagggccgtattcacctatctaccagacgaacaaccgtaaagtaacttactgttacngacaaatagaacngacctaggagacgccggacggacaggcttaggtcgttaattagttggtaggacgggtaaaggggcgaaggggtcgggtacggtcggggaactaggttacgggtaaccggtcggtacgggggggacccaaacgggggtaccccgaccggggttaccgtaaccccggtttcccg

SEQ ID NO: 343801 - DNA, 596 bp, Homo sapiens
  misc_feature: GZ8MTXP02FV3UT.19.48.E04.1.454.CMB.2.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtcccctgagactctcctgtacaggctctggggttctcctttagagttatggatgaactggcccncaggctcggggaagggccggagtgggtgccaacataaatgacaagatggaactggaagaaaaacgtntaggggactcgtggtggaaggggccgattccgactagtctccagagaaccaaacgtaaagaacttactgttactgactaaatagaacagcctagaggagaccggaaggaccacgggtctaggtgtttaattagtttagaggacggtaaaaggggcaaggttggaccgtgggacagttgggaacgtgtcgggggaccaaggggtaccaacgggccaccggttcc

SEQ ID NO: 343802 - DNA, 673 bp, Homo sapiens
  misc_feature: GZ8MTXP02GNTOE.19.48.E04.1.454.CMB.2.raw
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtggggggtccctggagactctcctgtacaggctctgggttctcctttagtagttattggatgaacgtcgggccccgccgagggccgtccggggggaaggggcccggaggtggggtcggcccaaacgataaatggacaaagagtggaaactggaaagaaaaactagtggggactcgtggtggaacggggcctagttccaccatcctaccagacgaaaccaaaccgtaaagtaacttacgtagtttacngaactaaatcgaaaacngacccttaggacgaacggcccggaagggacccacggggctaggttagtaatttagttggtggaacggaaagggggcaagggttcgggacgttagggggactaagggtcgggtaaccggttcgggtacgggggacccaaacgggggaccccacggggttacccgaacccggtttccc

SEQ ID NO: 343803 - DNA, 839 bp, Homo sapiens
  misc_feature: GZ8MTXP02IH46X.19.48.E04.1.454.CMB.2.raw
tcagtactctcgtgcacgaccggtgctcgatttagagagcgtcacagagagaagggggtctcagagaggagccttagccctggacctccaaggcctttccacttggtgatcagcactgagcacagacgactcaccatggaattggggctgagctgggttttcctcgttggtattttagaaggtgtccagtgtgaggtgcacctggtggagtcgtgggggagcgttggtccagccgtggggggtccctggagctctcctgtacaggctcgtgggttctcctttagtagttatggatgaactggcccgcgaggcgtcggggaagggcgaggtggtgcaacataagtgacaaagataggaactaggaaaagtaaaaacctagtacggggtactcgttagggtagggaaacggggtcccgtaaatttacccgaaccgtaacgttccttaaccccgaaaggaaacggttaaaaccccgtaaaacccccgggttaaaaggtaaacccttttaaaccgtttcggttttaccgttaacggtaaaccaaaaagttacggaaaacctacggaccccgttaaggaaaccgggtacggacccggaaacggggttaaaccgaaccccgggtcgtttaggttacgggtttaaattttaacggtttcgggtaggtaacccgggtaaaacgggacccggttaaacgggtttccggggaacccgggtttaacgggggaaactaaaaggggtttccggggaaacgggttttccggggtaccggggggaaaccccgtaaaaaacgggggtccccccggtaaaaccggggtttccccgtaaccccggggtttacccccg

SEQ ID NO: 343804 - DNA, 646 bp, Homo sapiens
  misc_feature: GZ8MTXP02FKTP6.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttgggtccaggccgtggggggtccctgagactctcctgtacaggctcgtggttctcctttagtagttatggatgaactcgggccccgcgagggcgtccgggggaaggggccggaggtggggtggccaaacataaatgacgaaagataggaactagaaagtaaaaacgtagtgggggactcgtaggtaggaacggggcctagttaccatcatcctaccgaagtaacgaacaaaccggtaaagtaaactttactgtttcgtagaactaaaagtcgaaacacgacctagaagacggaccggagaaccgacggtcgtagttagttattagttgtacggacggaaggggcaagggtggacgtacgggaactagttacgggaacgttcgggacgggggacgaaacggggcccgtacggaccgtaaccccg

SEQ ID NO: 343805 - DNA, 714 bp, Homo sapiens
  misc_feature: GZ8MTXP02I4TEU.19.48.E04.1.454.CMB.2.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttgggtccaggccgtggggggtccctgagactctcctgtacaggctctgggttctctttagtagttatggatgaactgggccccgcgaggcgtccgggggaagggccggagtgggtggaccaanataangacaaagntaggaactagaagaaaaactgtaggggactcgtagtggaaagggcctaattccaactatcctaccgaaagaacgaaccaaaccggtaaagtaaactttacgttgttttacctaggtaacctaaaagttacgaaacgtacggtcccttaggaaacggacggacccggaaaggggaacccaaccggggtccttaggttacgtttaaagttttagtttagggtacgggtaaccgggtaaaagggggtaccgtaaggggtcgggtaccggttaggggaacgtaggtcggggtaacggtcggttaccgggggaacccgtaaacgggggaccccgtaacggggtccctaacccgggttcccg

SEQ ID NO: 343806 - DNA, 681 bp, Homo sapiens
  misc_feature: GZ8MTXP02JOX9E.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacgtggtggagtcgtgggggaggtcttggtccaggccgtgggggtccctgagctctctgtacagctcgtggttctcttagtagttatggtatgacgtcgggcccgccgaggccggtaccgggggacggggccggaggtggggtcggaccgaaacataagtggacaaagagtacggaactaggaaagtaaaaacgtaggtacggggtactcgtaggtcgggaacgggtaccgtacgttaccacgtactccgtaccgaacgaacgaaaccgtaaaaccgtaaacgttaaactttaccgttatttaccgtagtaaactaaagtacgaaacgtaacgaccgtaggaacgacgggaccggaacgggacgacggtctaggttagttattagtgtagacgggaacgggtggtagggtcggacggtacggacgtaggtcggtacggtcggacggggaccgaaacgggcccgtacggtcccgaccgttccccg

SEQ ID NO: 343807 - DNA, 689 bp, Homo sapiens
  misc_feature: GZ8MTXP02H559O.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtattttagaaggtgtccagtatgaggtgcacctggtggagtcgtgggggaggcttggtccagccgtgggggtccctgagactctctgtacaggctcgtgggttcttcgtttagtagttagttggatagacgtcgggccccgcgagggccggtaccggggggaggggccggagggtggggtcggaccaacgataagtgacaaagacgtaggaactaggaaagtaaaaacgtgtaggggtactcggtagtgggaacgggtccgtattaccaccatccgtaccgaagaacgaacctaaaccgtaaacttaaccgttacgtttacgttttacgtagtaactaaaagtgaaacgacggtacctagggacggtacggaccgggaaggaccgacgggtcttaggttagttaatttaggtggtcgaacgggtaagggcgtaagggtggacggtagggaccgtaggtacgggtacggtcggtacgggggaacccgtaacgggggaccgtaccgggtcctaacccggtccg

SEQ ID NO: 343808 - DNA, 832 bp, Homo sapiens
  misc_feature: GZ8MTXP02IY3TD.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattgggtctgagctgggttttcctcgttggtattttagaaggtgtccagtgtgaggtgcacctggtggagtcgtgggggagcttggtccagccgtgggggtccctggagactctctgtacaggctcgtgggttctcctttagtagttatggatgaacgtgggccccgcgaggccgtccgggggaagggccggaggtcgggtggaccaaacagtaagtgacaaagagtaggaactagaaaagtaaaaacgtaggtaggggtactacgtaggtaggggaacggggtacccgtaagtttacccaaccgtaacgttaccctacccgaaaggaaaccgtaaaacccgtaaaaacccgggtttaaaacgtaaaaccctttttacgtttacgtttttaccgaacggaaacctaaaaagtacgaaaaccgttaccgggacccttaagggaaacgggtacggacccccgggaaaggggaacccgtaaccgggggtcctttagggttacgtttaaaaggttttccgtttaggggtaccgggaacggggtaaaacgggggtccgtaaagggggtttcggggaccgggttaagggggaaccgttaaaggggtcggggtaaaccggtttccggggtaaccgggggaacccggttaaaaccgggggacccccgtaaaccggggttccctaaaccccgggtttccccg

SEQ ID NO: 343809 - DNA, 645 bp, Homo sapiens
  misc_feature: GZ8MTXP02F8HSN.19.48.E04.1.454.CMB.2.raw
  modified_base (263)..(263): a, c, t, g, unknown or other
  misc_feature (263)..(263): n is a, c, g, or t
  modified_base (457)..(457): a, c, t, g, unknown or other
  misc_feature (457)..(457): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtatttagaaggtgtccagtgtgaggtgcaccgtggtggagtcgtgggggaggcttggtccagccgtggggggtccctgagactctcctgtacnggctctggggttctcctttagtagttattggatgaactgggcccgcaggcgtccggggaaggggccggaggtggggtggccaacataatgacaagataggaactaggaaagaaaaactagtagggggtactcgttggtgaaaggggcctattccaccatctcccaagagaaccaaacgtaaagtaacttacttnttcagacaaatagaacagcctaggacgacgacccgaagggaccacggggcttggtaggttaatttagtaggttggacgggtaaaagggcgtagggtcgggccgttaggggaactaaggtcggtaaccggttcgggtcgggggaacccggaacgggggaccccgtacgggtaccgaccccggtttcccg

SEQ ID NO: 343810 - DNA, 772 bp, Homo sapiens
  misc_feature: GZ8MTXP02G891C.19.48.E04.1.454.CMB.2.raw
  modified_base (261)..(261): a, c, t, g, unknown or other
  misc_feature (261)..(261): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacnggctcgtgggttctcctttagtagttattggatgaacgtcgggccccgcaggccgtccgggggaaggggccggaggtgggtggaccaaacataaatgacaaagagtaggaactaggaaagaaaaacgtgtacgggggtactcgtagtgggaaacgggtccgattaccgacctatcctacccaagaacgaaccctaaacggtaaaacgaaactttaacgttgtttacctaggaacctaaaagtacgaaaccaggtaccccgtaggaacgggaacggacccggaaggggaacccgaacggggtaccgttaggttggtttaaaagtttacggtttggtacggggtaaacggggtaaaacgggggcccggttaaaggggtcggggttaaccggttagggggaaaccgtagggttaccgggggttaaaccggggtccggggttaccgggggaaaccccggtaaaacgggggaacccccggtaccgggggtttaccccaaccccggtttacccccgg

SEQ ID NO: 343811 - DNA, 781 bp, Homo sapiens
  misc_feature: GZ8MTXP02IA2DM.19.48.E04.1.454.CMB.2.raw
  modified_base (317)..(317): a, c, t, g, unknown or other
  misc_feature (317)..(317): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgtttggtattttagaaggtgtccagtgtgagtgcactggtggagtcgtgggggagcttggtccagccggtgggggtccctggacgactctctgtacgaggtctcgttgggttcttccgtttagttagttattgggatgaacgtcgggccccncgaggccggtaccggggggaagggcccggaggtacgggtcgggacccaaacgtaagtaaagtgaccgaaagtagtaggaactaggaaaagtaaaaacgtgtggggacttcggtagtacgggaacggggcctagttaccaccgattccaccgaacgtaagaaaccctaaaacggtaaacgttaaacctttactttacggtttactaacggtaactaaaaacgttcgaaaaccgaacggttcccgtaagaacgggtaacggacccgggtaaacggggaaccgaaccggggtactttagggtttaagtttaacttttaagggtgggttaacggggaccgggttaaaacgggggtcgtaacggggtcgggtacgggtacgggaacgttacgggtaccgggttaccggtaaccggggtaccggggaaaccggtaaccgggtaacccgtaccggtacccgtacccgtccg

SEQ ID NO: 343812 - DNA, 667 bp, Homo sapiens
  misc_feature: GZ8MTXP02GLFYR.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctgagactctcctgtacnggctctgggttctcctttagtagttatggatgaacgtcgggccccgcaggccgtccggggggaaggggccggaggtggggtggaccaacataatgacaaagataggaactagaaagaaaaactgtaggggactcgtaggtggaacgggcctagttccaacctatcctaccagagaaaccaaacgtaaagaacttactagtttcctagacaaaatcgaaacacggtcctaggaacgaggacccggaggaacgaccgggtcttaggttgttaatttagttaggtagggaccggaaaggggcctaaggggtcgggtacggtaggggactaacggtggggaaccggttcggggtacgggggaacccggtaacgggggacccgtaccggggtaccctacccggttcccg

SEQ ID NO: 343813 - DNA, 561 bp, Homo sapiens
  misc_feature: GZ8MTXP02F41EV.19.48.E04.1.454.CMB.2.raw
  modified_base (417)..(417): a, c, t, g, unknown or other
  misc_feature (417)..(417): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagccgtggggggtccctgagactctcctgtacaggctctgggttctcctttagtagttattggatgaactgggcccgcaggctcggggaagggccggagtggtggccaacataatgcaagatggaactgagaaaaactagtggggactcgtgtgaagggccgattcaccatctccagagacaacgtaanacttactgttctgacaaatgaacagcctgagagccgaggacacggctgtgtattatgtgcgtaagggcaggtggcgtagggactagtcggaacgtcgtacgggggaccctaaacgggggacccgacgggtaccacccggttccc

SEQ ID NO: 343814 - DNA, 738 bp, Homo sapiens
  misc_feature: GZ8MTXP02J1FRB.19.48.E04.1.454.CMB.2.raw
  modified_base (263)..(263): a, c, t, g, unknown or other
  misc_feature (263)..(263): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcacctggtggagtcgtgggggagcttggtccaggccgtggggggtccctgagactctcctgtacnggctcgtggttctcttagtagttatggatgactgggcccgcaggcgtcggggaagggccggagtgggtcgccaacgataatgacaagatggaaactggaaagaaaaactgtaggggtactcgtaggtggaacggggcctattcaaccactcctcccgaagaacgaaacctaaaaccccgttaaaagtaaccgtttaaccttggttttaccaggtaactaaaacgttagaaaaccgacggacccgttaggaagggacggacccgggaacgggaacccgacgggtcgttaggttagttaattttaggttggtaggggtaacccggaaagggggtctaaggggtcggggtaccggttacgggggtaacgtaacggtagggggtacccgggtttaaccggtaaccgggggggtaacccccgaaaacggggggttaaacccccgtaccggggttaccccggttaacccccggtttccccg

SEQ ID NO: 343815 - DNA, 737 bp, Homo sapiens
  misc_feature: GZ8MTXP02HGZCP.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacnggctcgtggtctcttagtattatgatgacgtggcccgcgaggcgtccgggggaaggggccggaggtgggtgaccaacgataatgacaaagagtaggaactaggaaagtaaaaactggtaggggtaacttcgtagggtagggaacggggtaccgtaacttccgaaccctatacccgtaccgaaaggaaacgaaacccgtaaaaccggttaaaacggttaaaccctttcgtttacggtttttaccaggtaaacctaaaagttacgaaaaccgttacgacccgttagggaacggaacgggacccgggaaacggggaaccgaacccgggtcgttaggttagttaaacgtttacgttgggtacgggaaccgggtaaacggggcgtaaggggttcgggcggtacggggtacgaaggttcgggaacggttcgggacgggggaacccgaaacggggtaccctacggggtacccaccggtttcccg

SEQ ID NO: 343816 - DNA, 577 bp, Homo sapiens
  misc_feature: GZ8MTXP02JFDMC.19.48.E04.1.454.CMB.2.raw
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagctctcctgtacnggctctggttctcttgtagttnttggatgactggcccgcaggcgtcggggagggccggaggnggtgcaacataatgacaagagtaggaactagaaagaaaaactagtaggggtactcgtggtggaacgggccgattacaccgatcctccaagacgaaaccaaaccgttaaagaacctttacgttgtttacgtagactaaatacgaacacgtcctagaggacgaccggagggacacgggctgtgtaattagtgtgacggaagggcaggtgcgtaggacagtggacgtgacggggaccaagggccacggtcaccgtccg

SEQ ID NO: 343817 - DNA, 571 bp, Homo sapiens
  misc_feature: GZ8MTXP02GY8OG.19.48.E04.1.454.CMB.2.raw
  modified_base (489)..(489): a, c, t, g, unknown or other
  misc_feature (489)..(489): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctcctgtacaggctctgggttctcctttagtagttatggatgaactgggcccgcaggctccgggggaagggccggagtgggtgccaacataatgacaaagatggaactaggaagaaaaactagtaggggactcgtgtggaaggggccgtattccacctatcctaccagacgaaccaaaccgtaagaacttactgtttcagacaaatgaacagcctagagagccgaggacacggctgtntattatgtgcgaaggcaggtcggcgtgggacaggtaggacgtcgtcgggggaccgaacggggaccaccggtccaccggttcc

SEQ ID NO: 343818 - DNA, 688 bp, Homo sapiens
  misc_feature: GZ8MTXP02JX8VN.19.48.E04.1.454.CMB.2.raw
  modified_base (326)..(326): a, c, t, g, unknown or other
  misc_feature (326)..(326): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcggtgggggaggtcgttgggtccgaggcccggttcggggggtcccctggacgaccttctccgtgtacgaggtctcgttgggttcttcctttagtagttatggatgacgtcggccncgaggcgtcggggagggcggaggtggtgacaacataagtgacaagagtaggaactagaaaagtaaaacgtgtaggggtactcgtgtagggaacgggccgtattaccacgtactaccgtaccgaaagaacgtaaaccgaaaccgttaaacgtaacctttacgtttcgttactagaaacctaaagttacgaaacgtacgccgtaggacggacgaccggaaggaccgtacggtcgttagttagtttattaggtttggacggaacgggtaaggccgagggttcggaccgtagggactaggtccggggtacgttaacggggccggggaacccgacgggggaccctaccggggtacctaccggttccc

SEQ ID NO: 343819 - DNA, 681 bp, Homo sapiens
  misc_feature: GZ8MTXP02HL9A5.19.48.E04.1.454.CMB.2.raw
  modified_base (470)..(470): a, c, t, g, unknown or other
  misc_feature (470)..(470): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcgttggtccagccgtgggggtccctggagactctcctgtacaggctctgggttctcctttagtagttattggatgaacgtgggccccgccgaggccgtaccgggggaacggggcccggaggtggggtcggccaaacgataaatgtaaagagtaggaactagaaacgaaaaactgtaggggactcgtggtaggaggggtccgtaattccgacctatcctaccgaagaacgaaaccctaaaaccggttaaanaaaccgtttacttcgtttactagaaccgtaaaagttacgaaacagtacccgtaggaacgacggacccggaagggaaccgacggtccttaggtaggttatttagtggtgacgggaaagggcgtagggtggtacgtagggacgtacgttacgggaccggttcggaacgggggaccgaacgggggtaccaccggttccgaccgtttccctcccg

SEQ ID NO: 343820 - DNA, 718 bp, Homo sapiens
  misc_feature: GZ8MTXP02GW4H4.19.48.E04.1.454.CMB.2.raw
  modified_base (305)..(305): a, c, t, g, unknown or other
  misc_feature (305)..(305): n is a, c, g, or t
  modified_base (580)..(580): a, c, t, g, unknown or other
  misc_feature (580)..(580): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggagcttggtccagccgtgggggtccctggagactctcctgtacaggctcgtgggttctctttagtagttatggatgaacgtgggccccncgaggcgtccgggggaaggggccggaggtgggtggaccaacataatgacaaagagtaggaactaggaaagaaaaacgtgtaggggacttcgttagggtaggggaaacgggtaccgaagttaccaacccgtacttccgtacccgaaaggaaaccgaaaacccgtaaaacccgttaaaacggtaaacctttaccgtttagttttaccgagtaaactaaagtagaaacctaaaggcccgttaaggacggaacggccggaaagggacccgaaccgggtnttaggttagttaaatttgttagggtaggaaccgggtaagggacgtagggtccggtaggttagggacgagtcggggtaacgtccgggggacggggaacccggaaacgggacccgtaccggtacccgtacccggtttccc

SEQ ID NO: 343821 - DNA, 725 bp, Homo sapiens
  misc_feature: GZ8MTXP02H62QA.19.48.E04.1.454.CMB.2.raw
  modified_base (288)..(288): a, c, t, g, unknown or other
  misc_feature (288)..(288): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctgggtggagtcgtgggggaggcttggtccaggccgtggggggtccctgagactctcctgtacaggctctggttctctttagtagttntggatgtaacgtcggccccgccgaggccgtccgggggaaggggccggaggtggggtggaccaacataatgcaaagagtaggaactagaaacgaaaacgtagtggggtactcgttggtgggaacgggtccgtaacgtttaccgaacctacgtacctaccgaaagaacgtaaacccgaaaacccgttaaacggtaaaccttttaaacgttgttttaccgtacgaaccgtaaaagtacgaaacgacgtcccgtaggaacggacggacccggacgggacgaccggggtcttaggtaggttaaatttgttggtacggacgggtaaaggggacgtagggtacgggtacggttacggggaagtaccgggttgggtaacccgggttcggtccgggggaacccggaaacgggggacccgtaaccggtccgtaaccccgtttccccg

SEQ ID NO: 343822 - DNA, 615 bp, Homo sapiens
  misc_feature: GZ8MTXP02IW67R.19.48.E04.1.454.CMB.2.raw
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggcttggtccagccgtgggggtccctgagactctcctgtacaggctctgggttctcctttagtagttatggatgaacgtggccccgccgaggcgtccgggggaagggccggaggtggggtggccaacgataagtgacaaagngtaggaactgaaagaaaactagtggggactcgttggnggaagggccgtattaccaccatctaccaganacaaaccgtaaagacttatgtttacngacaaatgaacagcctagacgagccgaggaccacggctgtagtatttatggtggacgtaaagggggctaagggtcggacgtacgggtacacggttgggaaccggttcggtcgggggaacccaaacgggggaccctacggggtacctaacccgggttccc

SEQ ID NO: 343823 - DNA, 685 bp, Homo sapiens
  misc_feature: GZ8MTXP02I6NHQ.19.48.E04.1.454.CMB.2.raw
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggagcttggtccagccgtgggggtccctgagactctcctgtacaggctgtggttctcttagtagttntgatgactcggccncgaggcgtcggggaaggccggaggtggtgacaacataatgacaaagngtaggaactagaaagtaaaaactgtacggggtactcgttaggtgggaaacggggcctagttaccaaccgtactaccgtacccgaaagaacgtaaacccgaaaccggttaaaacgaaccttttaccgtttagttttcccgaataaccgtaaaattcggaaaactacggtccttaagggaacgacggtaacccgggaacgggaaaccgtaccgggtattggtttaggttaaactttagttacggggtgaaaccggggtaagggctaggggtcggacggttgggactaggttcggaacggttcgggacgggaccgtaaacgggccgtacggtccgaacccgttcc

SEQ ID NO: 343824 - DNA, 716 bp, Homo sapiens
  misc_feature: GZ8MTXP02JTBNE.19.48.E04.1.454.CMB.2.raw
  modified_base (196)..(196): a, c, t, g, unknown or other
  misc_feature (196)..(196): n is a, c, g, or t
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctggttttcctcgttggtattttagaaggtgtccagtgtgaggtncaccgtggtggagtcgtgggggagcttggtccagccgtgggggtccctgagactctcctgtacnggtctcgtggttctcttagtagttatggatgaacgtcggcccgcgaggccgtaccggggaagggccggaggtggtcgacaacgataagtgacaagataggaactagaaagaaaaacgtgtaggggactgtggtaggaacgggcgtagttccaactacttccacccgaagaaccgaaacctaaaccggtaaagtaaaccgtttacgttcgtttacgacgtaactaaagtacgaaacaggtcccttaggacgaacggaccggaagggaaccgacgggtacgttacgggttagttaacgttttagttacgggtaggaacccgggtaaggggtaccgtaaggggtccgggtacgggttaacggggacgtaacgggttcggggaaccggtttccgggaacgggggtaacccgaaacgggggtaccccgtaaccgggttaccccgaacccgggtttaccccg

SEQ ID NO: 343825 - DNA, 674 bp, Homo sapiens
  misc_feature: GZ8MTXP02FMD4Y.19.48.E04.1.454.CMB.2.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggaggcttggtccagccgtgggggtccctgagactctcctgtacaggctcgtgggttctcctttagtagttatggatgacgtggcccgcaggcgtccgggggagggccggaggtcgggtggccaanataagngacaagataggaactaggaaagtaaaaacgtagtaggggactcgtggtagggaacgggaccgtattacccgaacctatcctacccgaagaacgaaaccaaaccgtaaacgtaaacctttaacgttcgtttacctagaactaaagtacgaaacacgtccgtagaacggacgacggaacgggaccgacggtcgttagttagttaagtttagtggtaggacggaaggggtctagggtcgggacgttaggggaactacggtcggtaaccggttcgggacgggggaaccgacgggggtacccgtaaccgggtaccgacccggtttcccg

SEQ ID NO: 343826 - DNA, 650 bp, Homo sapiens
  misc_feature: GZ8MTXP02JL681.19.48.E04.1.454.CMB.2.raw
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggtttctcgttaggtatttagaaggtgtcagtgtgaggtgcacgtggtggagtcgtgggggagcttggtccagccggtgggggtcctgagctctcctgacaggctcgtggttctcgttagtagttatgatgacgtcggccncgaggccgtccgggggaagggccggtaggtggcgaccaacagttaagngacgaagtagtagaanaagaaagtaaacgtggtacggtactagtaggtacggacggactactacactctcgacgaagaacaaacgtaacgtaagttaactttcgttacttacgaataacgtaaagacgaacgacgtcgaaggacgacgacggaggacgtaggtgtagttagttagttaggtagggtaacggacgggtaacgggcggtacgggtacggtacggtacggtacggtacggtacgggtacgggtaacgggtacgggaaccgggtaaccgggtaccggtaccggtacccggtacccgtcccg

SEQ ID NO: 343827 - DNA, 711 bp, Homo sapiens
  misc_feature: GZ8MTXP02G25SJ.19.48.E04.1.454.CMB.2.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggagtcgttggtccaggccgtgggggtccctgagtactctcctgtacnggtctcgtgggttctctttagtagttatggatgaacgtcggcccncgaggccgtacggggagggccggagtgggtcgaccaanataagngacaaagagtaggaanacgaaagtaaaaacgtgtaggggtactcgtaggtagggaacgggtaccgtattaccaacctagtacctaccgaagaacgaaaccgtaaaccgtaaagtaaacctttacgtttacgttacctaggtaactaaaagtacgaaacgtacgtaccgtaaggaacggacggacccggaagggaaccgaccgggttacgtaggttaagtttaattaggtttagggcggaacgggttaaaacggggctaaggggtcggacggttaaagggaccgtaaggtcgggtaaacggtcgggaccgggggaaccgtaacggggacccgtaaccggtaccgtacccggtccccg

SEQ ID NO: 343828 - DNA, 750 bp, Homo sapiens
  misc_feature: GZ8MTXP02GWIX5.19.48.E04.1.454.CMB.2.raw
  modified_base (305)..(305): a, c, t, g, unknown or other
  misc_feature (305)..(305): n is a, c, g, or t
  modified_base (577)..(577): a, c, t, g, unknown or other
  misc_feature (577)..(577): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacgtggtggagtcgtgggggagcttggtccagccgtgggggtccctgagactctctgtacaggctcgtgggttctccgtttagtagttatggatgaacgtgggcccncgaggccgtccgggggaaggggccggaggtggggtggaccaagataagtgacaaagagtaggaactagaaacgaaaaactaggtaggggtactcgttaggtggggaaacggggccgtaatttacccgaacccgtattccgtacccgaaagaacgtaaacccgtaaaccggtaaaagtaaaccctttaacgttgttttaccaggtaacctaaaagttcgaaacctacggacctaaggaaggacggacccgggaagggtacccgaacccgggtnttagggttagttaagtttagttagggaggaccggggtaaggggtaccgaggggttcgggacggttacgggggaacctaaggggttcggggtaaccggttccgggggtacgggggaacccccggtaaaacgggggaccccctaccggggttaccccgaaacccggtttcccccg

SEQ ID NO: 343829 - DNA, 560 bp, Homo sapiens
  misc_feature: GZ8MTXP02IEVHK.19.48.E04.1.454.CMB.2.raw
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctgagactctctgtacnggctgtggttctcttagtagttntgatgacgtggccncgaggcgtcggggaggcggagtggcgacaacatatgacgaagagtaggaactagaaagaaaaacgtgtaggggactcgtgtggagggctagtcaccngtcncaagagaacctaaacgtagaacttattgttcatanaaatcgaactacgctagagacgcgaggacaggnttgtgtaattgtagtagcggtaagggctggtacgtcgagggacaggtcgacggttcgacggggaccaacggggtaccaccggtacacccggtcc

SEQ ID NO: 343830 - DNA, 640 bp, Homo sapiens
  misc_feature: GZ8MTXP02FNPFJ.19.48.E04.1.454.CMB.2.raw
  modified_base (557)..(557): a, c, t, g, unknown or other
  misc_feature (557)..(557): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcgttggtccagccgtgggggtccctgagactctcctgtacaggctcgtgggttctcctttagtagttagttggatgaacgtcgggccccgccgagggcgtccgggggaaggggccggaggtggggtggccaaacataaagtgacaaagtagtaggaactagaaagtaaaaacgtagtaggggactcgtaggtggaagggcgtattccacctactctaccagacgaaccaaccgtaaagaaccttatagttctagaacaaatacgaacagtcctagaggacggaccgaagggaccgaacgtcgtggttagttattagttgtcggacgggtaaacggggngtaggtcggacgtacgggacgacggtacggtaccggtcgggacggggaccggaaacgggtacccgacggtccgacccggtccg

SEQ ID NO: 343831 - DNA, 652 bp, Homo sapiens
  misc_feature: GZ8MTXP02G34WG.19.48.E04.1.454.CMB.2.raw
  modified_base (305)..(305): a, c, t, g, unknown or other
  misc_feature (305)..(305): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctcgtgggttctctttagtagttatggatgaacgtcgggcccncgagggcgtaccgggggaaggggccggagtggggtcgaccaacgataaagtgacaaagagtaggaactaggaaaagaaaaacgtgtaggggtactcgtaggtagggaacggggcctaattaccgaccctaagtcctaccgaaagaacgaaacctaaaacccgtaaagtaaccctttaacgttaggttttccaggtaacctaaaatacggaaacacggtacctaggacggaacgaccggaagggtaaccgacggtactgttaggtattagtggtagacggaaggcagggtcgaggtacggacaggtcggacgtcggcgggaacgacggaccgacggtacgtaccgtcg

SEQ ID NO: 343832 - DNA, 709 bp, Homo sapiens
  misc_feature: GZ8MTXP02JPDCS.19.48.E04.1.454.CMB.2.raw
  modified_base (308)..(308): a, c, t, g, unknown or other
  misc_feature (308)..(308): n is a, c, g, or t
tcagtactctcgtgcacgaccggtgctcgatttagagagcgtcacagagagaagggggtctcagagaggagccttagccctggactccaaggccctttccacttggtgatcagcactgagcacagacgactcaccatggaattggggctgagctgggttttcctcgttggtatttagaaggtgtccagtgtgaggtgcaccgtggtggagtcgtgggggagcttggtccaggccgtgggggtccctgagactctcctgtacgaggctcgtggttctccgttagtagttatggtatgacgtcgggcccncgaggcgtcggggaagggccggagtgggtgccaactataagtgacaaagagtaggaactaggaaagaaaaacgtggtaggggtactcgtggtagggaacgggtccgtaagttaccaaccgtactccgtacccaaggaacgaaacccgtaaaccggtaaagtaacctttaccgttagtttccgagtaaccgtaaatacgaaacgtacgaccgttaggaacggaacgacccgggaaacgggaccgaacgggtcgttaggtttaagttaagttttagttacgggtacggacgggtaaaggggtcgtaggggtcgggtaccggtaggggacctaaggtccgggtaacggtcgggtacgggggaaccgtaaaacggggcccgtaacggtcccgtacccgttacccg

SEQ ID NO: 343833 - DNA, 691 bp, Homo sapiens
  misc_feature: GZ8MTXP02JRT25.19.48.E04.1.454.CMB.2.raw
  modified_base (305)..(305): a, c, t, g, unknown or other
  misc_feature (305)..(305): n is a, c, g, or t
  modified_base (573)..(573): a, c, t, g, unknown or other
  misc_feature (573)..(573): n is a, c, g, or t
  modified_base (593)..(593): a, c, t, g, unknown or other
  misc_feature (593)..(593): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcacctggtggagtcgtgggggagcttggtccagccgtgggggtccctggagactctcctgtacaggtctcgtggttctcctttagtagttatggatgacgtcgggcccncgaggccgtcgggggaagggccggaggtgggtggaccaacataaagtgacaaaggagtaggaaactaggaaaacgtaaaaacgttaggtacgggggtaactcgttagggtagggaaacgggggtaccgtaacttaccgacctaactcctacccgaaagaacgaaaccctaaacccggttaaagtaacctttacgttgtttaccgtaacgtactaaaattcgaaaacctacggtcctagggaacgacggacccggaagggaccacggtntaggttagttagttagttgnggaacggtaggggctaggggtcggtacgtagggggtaacaggttacgggacggttcggacgggggaaccaacgggggcctaccggtccacccggttcc

SEQ ID NO: 343834 - DNA, 732 bp, Homo sapiens
  misc_feature: GZ8MTXP02FWUBT.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcgttggtccaggccgtggggggtccctgagactctcctgtacaggctctgggttctctttagtagttatggatgaacgtgggcccgcaggccgtccgggggaagggccggaggtgggtggaccaacataatgacaagataggaactagaaagaaaaactgtaggggactcgtagtgggaacgggccgtagttaccaacctatccgtacccgaagaacgtaaaccgtaaaacccgtaaaaggtaaaccctttaacgtttcggtttaccctaggtaaacctaaaagttacgaaaaccgtacggtaccccttaagggaaacgggaacgggaccccgggaaaggggaaccctaaccggggtcttaggttagtttaaaagtttcgttagggttcgggaacgggtaaaaggggtcgtaagggttcgggacggttaggggaactaaggtcggggtaacggtccgggtacgggggaccgtaaaacgggggacccgaccggttaccgacccggtttcccg

SEQ ID NO: 343835 - DNA, 613 bp, Homo sapiens
  misc_feature: GZ8MTXP02GV1B8.19.48.E04.1.454.CMB.2.raw
  modified_base (262)..(262): a, c, t, g, unknown or other
  misc_feature (262)..(262): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacnggctctggggttctcctttagtagttattggatgaacgtgggccccgccgagggccgtccgggggaaggggccggaggtggggtggaccaaacataaatgacaaagagtaggaactagaaacgaaaaaacgtagtagggggtactcgtagtgggaaacgggccgaagtttccaaccatcctaccgaagagaacaaaccgtaaagaacttatgttctgacaaatgaacagctagagagaccgaggacacggctgtagtattatgtgacggaggcgaggtcggacgtgggactagtcgggaacgtcggtcggggaacccgaaaggggaccctacggggtaccctaccggtccc

SEQ ID NO: 343836 - DNA, 728 bp, Homo sapiens
  misc_feature: GZ8MTXP02G3PLR.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcgtggtttccgtcgttaggtatttagaaggtgtcagtgtgaggtgcacgtggtggagtcgtgggggaggcttggtccaggtccggtcggggggtccccagtactctccgtgtacaggctcgttggttctcttagtagttatggatgacgtcggccccgcgaggcggtaccggggaggggccggaggtggggtcggaccaacgataaggtgacaaggtagtgggaactaggaaaccgtaaaaacgtggtacggggtaaccttgtaggtacgggaacggggtcctattacccaactacgtacctaccgaaagggaaacgtaaaccctaaaacccggttaaagtaaacctttacgtttaccggtttattaacggaacctaaaaggttaccaaaaccgttgacccggtagtaacggacggacggaaacggttaccgagggtcttaggttagtttaatccggttgtaggacgggtaacgggacggtaggtggacggtacgggtacggtacggtacggtacggtacggtaacgggtaaccggtaacgggtaccggtaccggtaccggtaccgtaccgtacccg

SEQ ID NO: 343837 - DNA, 825 bp, Homo sapiens
  misc_feature: GZ8MTXP02GBCEB.19.48.E04.1.454.CMB.2.raw
  modified_base (305)..(305): a, c, t, g, unknown or other
  misc_feature (305)..(305): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcttggtccagccgtgggggtccctgagactctcctgtacaggctcgtggttctcctttagtagttatggatgacgtgggccccncgaggcgtccgggggaagggcccggaggtgggtggaccaaacgataaagtgacaaagagtaggaactaggaaaagaaaaacgtaggtacggggaccttcgtagggtaggggaaaccggggtccgtaaagtttcccaacccgtaagtcccgttacccgaaagaaccggtaaaccgtaaaaaccccgggttaaaacggtaaacctttttaacgttacggttttaccttaacggaaccctaaaaagtaccggaaaacgaaccggtaccccttaggggaaaacggtaccggaaccccggggaaacggggtaaaccccaccgggggtaccgtttagggtttacggttaaagtttaaaggtttggtaaccggggaacgggtaagggggacctaagggggtttaccgggcgggttaagggggaaacctagggttacgggggtaaaccggttccgggggttacggggggaaccccaaaaccggggggacccgtaacccggggtttacccgtaaccccggttttccccg

SEQ ID NO: 343838 - DNA, 663 bp, Homo sapiens
  misc_feature: GZ8MTXP02HDX33.19.48.E04.1.454.CMB.2.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcactggtggagtcgtgggggagcttggtccagccgtggggggtccctgagactctcctgtacaggctcgtgggttctcctttagtagttattggatgaactgggcccgccgaggcctcgggggaaggggccggaggtggtgaccaanataaagngacaaagagtaggaactagaaagtaaaactaggtggggactcgtgtagggacgggccgattaccgaccatcctaccgaagaacgaacccaaacgtaaagtacttatttagtttccagaacaaagtcgaaacncgtacctggaaacgacgaccgggaagggaaaccncgggtactaggttagttaacttaggttagggacggaacgggtaaacggcggtagggtcggtacggtacgggtacgtaagggtcgggtaacggtcgggtaccgggggaaccggaaacggggaccgtacccggtacccgtaccgtccg

SEQ ID NO: 343839 - DNA, 560 bp, Homo sapiens
  misc_feature: GZ8MTXP02FGSRL.19.48.E04.1.454.CMB.2.raw
  modified_base (331)..(331): a, c, t, g, unknown or other
  misc_feature (331)..(331): n is a, c, g, or t
  modified_base (402)..(402): a, c, t, g, unknown or other
  misc_feature (402)..(402): n is a, c, g, or t
  modified_base (471)..(471): a, c, t, g, unknown or other
  misc_feature (471)..(471): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttggtccagcctggggggtccctgagactctcctgtacaggctctgggttctcctttagtagttattggatgaactgggcccgcaggctccggggaagggccggagtgggnggccaacataatgcaagatggaactgaagaaaaactagtggggactcgtgtgaaggggccattcaccatcncagagacaaaccgtaagaacttactgttctgacaaatgaaacagcctagagagccgaaggacaccggtntagtgtattagtgtgacggaagggcaggtcggcgtagggacacggtggacgtcggcggggaccgaacggggacccgacggtccaccgtc

SEQ ID NO: 343840 - DNA, 694 bp, Homo sapiens
  misc_feature: GZ8MTXP02FUFEX.19.48.E04.1.454.CMB.2.raw
  modified_base (262)..(262): a, c, t, g, unknown or other
  misc_feature (262)..(262): n is a, c, g, or t
  modified_base (534)..(534): a, c, t, g, unknown or other
  misc_feature (534)..(534): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcgttggtccaggccgtgggggtccctgagactctcctgtacnggctcgtggttctcgttagtagttagtggatagacgtcgggccccgcgaggccgtccgggggaagggccggaggtcggggtagaccaacgataagtcgacaagagtaggaactaggaaaacgtaaaaacgtaggtaggggtactcgtaggtggaacgggccgtacttacacctatcctacgaagacgaaaccaaaccgtaagtaacttacgttgttactagaactaaagtacgaaacctagccctaggaacggacgtccggaagggaacccncgggtacgttaggttagtttaaagtttaggttagggtacggaaccggggtaaaggggtaccgtagggttacggggacggttaggggacgtacggtcggggtacgttccggggacggggaaccggaacggggtacccgtacggaccgtaacccggtttccc

SEQ ID NO: 343841 - DNA, 714 bp, Homo sapiens
  misc_feature: GZ8MTXP02FPLC8.19.48.E04.1.454.CMB.2.raw
  modified_base (258)..(258): a, c, t, g, unknown or other
  misc_feature (258)..(258): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtatttagaaggtgtccagtgtgaggtgcacctggtggagtcgtgggggagcttggtccagccgtgggggtccctgagactctcctgtacnggctcgtggttctctttagtagttatggatgacgtcgggcccgcgaggcgtaccggggggaaggggccggaggtggggcggaccaaacgataacgtgacaaagagtaggtaactaggaaaacgtaaaaacgtaggtaggggtactcggtagggtgggaacggggtccgtattaccgacctaacttccgacccgaaagaacgaaacccgtaaaacccggttaaagtaaacctttacgtttacgtttacgtacgtaaactaaagtacggaaacacggtccctagggaacggacggaccgggaaggaaccgtaccggtgttaggttgtttaagttagttagggtggaccggggtaaagggcgtaagggtcgggacgtaggggaccgtaggtcgggtaacggtcggggtacggggacccggtaaacgggggacccgtacgggtaccgacccggtttcccg

SEQ ID NO: 343842 - DNA, 844 bp, Homo sapiens
  misc_feature: GZ8MTXP02FSEYF.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcaccgtggtggagtcgtgggggaggtcgttggtccaggccggtgggggtccctgagactctctgtacaggtctgtggttctcgtttagtagttatggatgacgtcgggcccgcgagggccggtccgggggaaggggccggaggtcggggtcggaccaaactagtaagtgacaaagtagtaggaaacgtaggaaaacgtaaaaacgtaggtacgggggtactcggttagggtacgggaaacggggtcccgtaaacgtttccgaaaccctagttaccccgtacccgaaaagggaaccggtaaaaccccgtaaaaacccgggtttaaaacggttaaaccctttttaacccgtttacgtttttaccgtaacggtaaaccgttaaaagttaaccgaaaacgtaacgggtaccccgttaaaggggaaaccgggtaaccggtacccccgggggaaaagggaacccggttaaccggggtcgtttaggttaacggttttaatttaaggttcggggttaaagggacgggtaaaacgggggcgtaaggggttcggggacgttacgggggaactacgggtacgggtaccgggttccgggtacgggggaaccccgtaaacgggggacccctaccgggggtcccctaaccggtttccccg

SEQ ID NO: 343843 - DNA, 844 bp, Homo sapiens
  misc_feature: GZ8MTXP02F98AV.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcttggtccaggccgtgggggtccctgagactctcctgtacaggctcgtgggttctcttagtagttattggatgaacgtgggcccgccgaggctccgggggaaggggccggaggtggggtggacctaaacgataagtgacgaaagagtacggaaaccttaggaaaacggtaaaaaaacgttaggtacggggggtaaccttaccggttagggtacggggtaaaacgggggtcccggtaaacttttcccgaaacccctaagtttaccccgttaaccccgaaaggtaaacgggtaaaccccgtaaaaacccggggttaaaaacggttaaaacccttttaaaccgtttacggtttttaaccgtacggtaaacccgtaaaaaagttaccggaaaaccgaacgggtaccccgttaagggaacggtaacgggaacccccgggaaagggaacccgaaccgggtaccgtttacggtaaggtttaacgttagtttacgggtcggaacggggtaaaacgggggtcgtaaggggtacgggtccgtaagggggtacctaaggttcggggtaaaccggtcggttaacggggggacctaaaacgggggtaccccgtacgggtacccgtacccggttacccg

SEQ ID NO: 343844 - DNA, 641 bp, Homo sapiens
  misc_feature: GZ8MTXP02JSNQE.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccaggccgtggggggtccctggagactctcctgtacaggctctgggttctccttagtagttatggatgaacgtgggcccgcgaggcgtccgggggaaggggccggaggtggggtggccaaacgataaagtgacaaagatggaactaggaagaaaaactgtaggggactcgtgtaggaacgggccgtattccgaaccagtcctaccgaagacgaaaccaaaccgttaaagaacctttaactcggtttaccaggacctaaatcggaaaccagcccgtaggacggacggacccggagggaccacggggtcttggttagtaatttagtggtacgaggaaagggctagggtcggagtcgggaactggtcggacgtggtacgggggaccgaaaacggggcctacgggtccaaccggttcc

SEQ ID NO: 343845 - DNA, 605 bp, Homo sapiens
  misc_feature: GZ8MTXP02IWSQ9.19.48.E04.1.454.CMB.2.raw
  modified_base (380)..(380): a, c, t, g, unknown or other
  misc_feature (380)..(380): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagctctcctgtacaggctcgtgggttctcttagtagttatggatgaactgggcccgcaggcgtcggggaagggccggagtgggtgccaacataatgcgaagagtggaactggaagaaaactagtcggggactcgngtggaacgggctaacgttcaacctatcctaccgaagacgaaacctaaacccgtaaagtaacccttttaagtcgtttacagactaaaagtgaaacacgtcctaggacgagacccggaggaccacggtntgtagtattagttgngacggaagggcagggtggcgtaggggactagtcgggacgtcgtacgggggacccaacggggacccacgggtaccaccggttcc

SEQ ID NO: 343846 - DNA, 674 bp, Homo sapiens
  misc_feature: GZ8MTXP02I0P5K.19.48.E04.1.454.CMB.2.raw
  modified_base (262)..(262): a, c, t, g, unknown or other
  misc_feature (262)..(262): n is a, c, g, or t
  modified_base (529)..(529): a, c, t, g, unknown or other
  misc_feature (529)..(529): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggcttggtccagccgtggggggtccctgagactctctgtacnggctcgtggttctctttagtagttatggatgacgtgggcccgccgaggcgtccgggggaaggggccggaggtgggtggccaacataatgacaaagataggaactagaaagaaaaactgtaggggactcgtggtgggaagggcctaagttccaaccgtatcctaccgagacgaaccgaaacgtaaagtaaacctttacgttagtttacctagaactaaaagtacgaaacacggtcctaggaacgaggaccccggaggaccgaaccggngttaggttagtttaaagtttgttagggtacggtaccggggaaaaggggtcgtaaagggtcggtacggttggggaacgtaggtcggtacggtcggtacgggggaccgtaaacggggacccgtacggtacccgtaacccggtttccc

SEQ ID NO: 343847 - DNA, 741 bp, Homo sapiens
  misc_feature: GZ8MTXP02FHXW4.19.48.E04.1.454.CMB.2.raw
  modified_base (262)..(262): a, c, t, g, unknown or other
  misc_feature (262)..(262): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggaggcttggtccaggccgtggggggtccctgagactctcctgtacnggctctgggttctctttagtagttattggatgaactcgggccccgccgagggccgtccggggggaaaggggccggaggtggggtggccaaacagtaatgacaagatggaactggaaagaaaaaccgtagtggggaactgtggtaggaacggggccgtattccgaacctatcctaccaagaacgaaacctaaaacccggtaaagtaaccgtttaacttggtttactacggtaacaaaagttacggaaaacctacggaccccgttagggaacggacggaccccgggaaagggaacccgtaaccgggggtctttggggttaagtttaacgtttaaggtttgggtagggaacccggggaaaagggggcctaagggggtcggggaccggttacgggggaaactaagggtcggggtaacccggtcgggtaccggggggaaaccaaaacggggggcccctaacgggggtacccacccgggttcccg

SEQ ID NO: 343848 - DNA, 579 bp, Homo sapiens
  misc_feature: GZ8MTXP02GFTF5.19.48.E04.1.454.CMB.2.raw
  modified_base (303)..(303): a, c, t, g, unknown or other
  misc_feature (303)..(303): n is a, c, g, or t
  modified_base (492)..(492): a, c, t, g, unknown or other
  misc_feature (492)..(492): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgtacaggctctgggttctcctttagtagttattggatgactgggcccncaggctccggggaagggccggagtgggtggccaacataatgacaagatggaactggaagaaaaactgtaggggactcgtaggtggaagggccgattccgaccatcctccagacaacaaacgtaagaacttactgtttcctgacaaatagaaactagcctagaagacgacccggaagggaccgaaccggntggtagttaattagttgtagacggaagggctaggtggacgtgggactagtggacgttggcggggacaagggaccacggtccacgtcc

SEQ ID NO: 343849 - DNA, 684 bp, Homo sapiens
  misc_feature: GZ8MTXP02JMNWG.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccggtgggggtccctgagactctctgtacnggctcgtggttctctttagtagttatggatgacgtcggcccgcgaggcgtaccgggggaagggccggaggtgggtgaccaaacagtaaatgacaaagagtaggaactagaaagaaaaactagtaggggactgtagtaggaagggccagttaccactatcctaccgaagacgaaaccaaaccgtaaagtaactttacgttagtttaccagtaacctaaagtacgaaactacggccctaagggacgacgacccggaagggaaccgacggtacgttaggttagtttagttaagttgggtacggaaccggggtaagggacgtaggggtggtaccggttaaggggaacctgggtacggggcccggttaagggaccgggggaacccggaaaacgggggtacccctacggggtacccgtacccggttcccg

SEQ ID NO: 343850 - DNA, 734 bp, Homo sapiens
  misc_feature: GZ8MTXP02JY3I3.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggcttggtccagccgtgggggtccctgagactctctgtacagctcgtggttctcgtttagtagttatggatgacgtcgggcccgcgagggccgtaccgggggaaggggccgggaggtggggtgacccgaaacgagtaaagtgacaaaggataggaactagaaacgaaaaacgtgtaggggacttcgtagggtaggaaacggggaccgacgtttaccaacccgtacttacctaccgaaaggtaacggaaaacccgtaaaacccggttaaaaggtaacccttttaaacgttcgttttaccaggtaaactaaagtacgaaaactcgtacgtaggaacggacgaccggaacgggaccgtaacgggtcgttagttaggttaatttacggttggacgtaacgggaacggggtctaaggggtcggtacggtacggggactacggtaggggtaccggttaacggggtaccgggggaaccgaaacggggtacccggtaccgggtaccgtaccccggttacccg

SEQ ID NO: 343851 - DNA, 603 bp, Homo sapiens
  misc_feature: GZ8MTXP02GB4K6.19.48.E04.1.454.CMB.2.raw
  modified_base (310)..(310): a, c, t, g, unknown or other
  misc_feature (310)..(310): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttgggtccaggccgtggggggtccctggacgactctcctgtacaggctcgtgggttctcctttagtagttatggatgaactgggcccncgaggcgtccgggggaagggccggaggtgggtgccgaaacataaatgacaaagataggaactagaaacgaaaaactgtaggggactcgtgtgggaacgggccgtattccgacctatcctaccagacgaaaccaacgtaaagacttactgttcagactaaatacgaacacgtacctgaacggcgaccgaaggacacggctagtgtattagtgtgacgtaagggcaggtggacgtgggacagtcgggaacgtcggtacggggaccgtaacggggacccacggtcccgacgtcccg

SEQ ID NO: 343852 - DNA, 592 bp, Homo sapiens
  misc_feature: GZ8MTXP02JY9OX.19.48.E04.1.454.CMB.2.raw
  modified_base (504)..(504): a, c, t, g, unknown or other
  misc_feature (504)..(504): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacaggctcgtgggttctcctttagtagttattggatgaactgggccccgcaggcgtccgggggaaggggccggaggtggggtggccaacataaatgacaaagatggaactagaagaaaaactagtcggggactcgtggtggaaaggggccgtattcaccatcctccagacgacaaaccgtaagaacttacttgttcagtacaaatgaacagcctgagagccgaggacacggctgtgtattagtgngacggaagggcaggtcgggacgtgggacagtcgggtacgtcggtcgggggacccgaacgggggaccctacgggtacccaccgttcccg

SEQ ID NO: 343853 - DNA, 679 bp, Homo sapiens
  misc_feature: GZ8MTXP02JOXOF.19.48.E04.1.454.CMB.2.raw
  modified_base (263)..(263): a, c, t, g, unknown or other
  misc_feature (263)..(263): n is a, c, g, or t
  modified_base (571)..(571): a, c, t, g, unknown or other
  misc_feature (571)..(571): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcgttggtccgaggccgtgggggtccctgacgactctcctgtacnggctcgtggggttcctcgtttagtagttatggatgaactcgggcccgcagggctccgggggaagggccggagtgggtgaccaacgataatgcaagagtggaactgaacgtaaaactagtacggggactagtgtggaaacggggctacgttaccacgacttcacccgagacgtaaacccaacgtaagtaaccttttacgtcgtttacgtacgtacaaaattcgaaacgtagtcccgagtaacggacgacgggacgtaaccggacggtcttcggttaagtactttaggttaggagaccggggtaacgggngtaaacgggttcgggacgttacgggggacccttaggggcggttaaccggtcggttaccgggggacctaaaccgggggtaccgaaccgggttccgacccggtttacccg

SEQ ID NO: 343854 - DNA, 669 bp, Homo sapiens
  misc_feature: GZ8MTXP02INUY9.19.48.E04.1.454.CMB.2.raw
  modified_base (600)..(600): a, c, t, g, unknown or other
  misc_feature (600)..(600): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcaccgtggtggagtcgtgggggaggcgttggtccaggccgtggggggtccctgagactctcctgtacaggctcgtgggttctcctttagtagttatggatgaacgtcgggccccgccgaggcggtccgggggaaggggccgggtaggtggggtggaccaaacataaatgacaaagagtaggaaactagaaagaaaaacgtagtaggggaactcgtaggtggaaacggggccctaagttaccacctactactacccaagtacgaaacctaaaacccggtaacgtaaactttacgttcgtttactagtaacaaaatagaaactagcctagagagacccgagggaccaacgggctaggtagttattagttggtagacggaagggcgtaggtcggagtcggggaaacnggtacgggacgttccgggacgggggaccgtaaaacggggacccgtaccggtacccgtaacccgttcccg

SEQ ID NO: 343855 - DNA, 626 bp, Homo sapiens
  misc_feature: GZ8MTXP02GQWBF.19.48.E04.1.454.CMB.2.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (400)..(400): a, c, t, g, unknown or other
  misc_feature (400)..(400): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtgggggtccctggagactctcctgtacnggctgtggttctcttagtagtatggatgacgtcggccncaggcgcggggagggcgagtggngcaanatatgacaaganaggactagaaagaaaactgaggggactcgtagtagggaaggccgtaattccgaaaccgtntcctacgacgagtaaacccgaaaacggtaactaaaccttacgttgtttaccagactaaaagtgaaaacctacgaccgttagaacgacgacccggaagggaaacccaccggtgttaggttacttaaggtttatttaccgggaggtaacggaaagggccgtaggtcggcgtagggactaggtcggtacgtcggtacggaaccgaggtaacccgcgtacggacttcccg

SEQ ID NO: 343856 - DNA, 735 bp, Homo sapiens
  misc_feature: GZ8MTXP02FPOHF.19.48.E04.1.454.CMB.2.raw
  modified_base (262)..(262): a, c, t, g, unknown or other
  misc_feature (262)..(262): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtacnggctcgtggttctcctttagtagttatggatgaactgggcccgcgaggccgtcgggggaaggggccggaggtggggtggaccaacgataatgacaagagtaggaactaggaaagtaaaaactagtacggggactcgtaggtggaaacgggccggtattaccgaacctactccgtacccaaaggacgaaacccgtaaaccgttaaaaggtaaaccttttacgttacggtttcttaacggaacctaaaagttacggaaaccgtaacggtcccttaagggaacggacgggaccccgggtaaagggaacccgaccggggtacgttaggttaagtttaattttacggtgggtacggggaacgggaaacggggtccggtaagggtcgggacggttacggggacctaggtcggggtaccgggtcgggtacggggaacccggtaacggggaccccgtacgggtaccctaccccggttcccg

SEQ ID NO: 343857 - DNA, 864 bp, Homo sapiens
  misc_feature: GZ8MTXP02JFKZ8.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtcagtgtgaggtgcactggtggagtcgtgggggagcttggtccagccgtgggggtccctgagactctcctgtacaggctcgtggttctcttagtagttatggatgacgtcgggcccgcaggcggtaccgggggaaggggcccggtaggtggggtcggacccgaaacgattaagtgacaaaggagtaggaaactacggaaagaaaaaaccgtgtacgggggtactcgtaggtacgggaaacgggtccgtaattaccaacctagttcctacccgaaagaaacgtaaacccgaaaaccggttaaacgtaaaccgtttaacgtttacgtttacccgtaggtaaacctaaaaagttacgaaaaccgtaacggtacccgttaagggaaacggaaccgggaccccgggtaaacggggtaaacccggaaacccggggttccgtttacgggtttagggtttaaacttttaaagggtttgggttacggggaaacccgggggttaaaagggggcccggtaaacgggggttcggggtcccgggtttaaggggggaaccctaaagggggtttcccggggtaaaccccgggggtttccgggtaacccgggggggtaaaaccccggaaaacccggggggtaacccccggttaaacccgggggttaacccccggtaaaacccccggttttacccccgg

SEQ ID NO: 343858 - DNA, 716 bp, Homo sapiens
  misc_feature: GZ8MTXP02GOSIW.19.48.E04.1.454.CMB.2.raw
  modified_base (635)..(635): a, c, t, g, unknown or other
  misc_feature (635)..(635): n is a, c, g, or t
  modified_base (673)..(673): a, c, t, g, unknown or other
  misc_feature (673)..(673): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggaggtcgttggtccaggccgtggggggtccctgagactctcctgtacaggctcgtggttctctttagtagttatggatgaacgtcgggcccgcgaggccgtccgggggaggggccggaggtgggtgaccaacgataaagtgacgaaagtagtaggaactaggaaagtaaaaacgtaggtaggggtaccttcgtagggtaggggaacgggtccgtaacttaccgaaccagttccctaccgaaagggaaacggtaaacccctaaaaccgggttaaaacgttaaacctttaacgtttcggtttaaccgtaggaaacctaaagtaccgtaaacgaacggtaccgttaaggacggacggacccggagggaacccgaccggtccgtactttaagttaggttggtagtagtagttaagtttggnggtacgtagtagggtcgttaggggtacgacgtaaggtntaccgggtacgtccgggggaaccgaccggggttaacctccggg

SEQ ID NO: 343859 - DNA, 677 bp, Homo sapiens
  misc_feature: GZ8MTXP02GU65C.19.48.E04.1.454.CMB.2.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattgggctgagcgtggtttctcgttaggtatttagaaggtgtcagtgtgagtgcaccgtggtggagtcgtgggggagtcttggtccaggtccgtgggggtccctggagactcgtcctgtacgaggtctcgtgggttctcctttagtagttatggtatgaacgtgggacccnccaggcgtccgggggaagggccggagtgggtgaccaanactaagtgactaaagntagggaactagaaacgaaaaactggtacgggactcgttaggngggaacgggtaccgtattaccgaactaactcctacccgaagtaataaacccgtaacccgttaaagaacctttaactgtttaccagaacctaaatcgaaactcgaccgtaggacgacgacggaacgacgaacgggtccttagtagtttaatagtttgacggtacggtaaacggggtcgtacggtcggacggtacggtacgtacggtacggtacggtaaccggtacgggtaaccggaaccgggtacccggtaccggtacccgtacccgtaccg

SEQ ID NO: 343860 - DNA, 738 bp, Homo sapiens
  misc_feature: GZ8MTXP02H0UYE.19.48.E04.1.454.CMB.2.raw
  modified_base (302)..(302): a, c, t, g, unknown or other
  misc_feature (302)..(302): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtcgtgggggaggcttggtccagccgtggggggtccctgagactctcctgtacaggtctcgtgggttctcttagtagttatggatgactcggccnccgaggcgtccgggggaagggccggaggtgggtcggaccaaacagtaaagtgacaaagagtaggaactagaaaagtaaaaaactaggtaggggaacttcgtaggtaggaaacggggtccgtaatttaccgaaccctaactcccgtacccgaaagaaccgaaaccgtaaaacccggttaaacgtaaaacctttaccgtttacgtttttaccgaaggtaaacctaaaagttacgaaaaccgtacggacccgttaaggaaacgggacggaaccccgggaaagggtaccgaacgggtacgttaggttagttaagtttagttaggtacggaacgggtaaaggggccgtaagggtcgggtacggttacggggaactagggtcggtaaccggtcggtacgggggaaccgaacggggaccgtaccggtaccgtacccggtcccg

SEQ ID NO: 343861 - DNA, 679 bp, Homo sapiens
  misc_feature: GZ8MTXP02HS11N.19.48.E04.1.454.CMB.2.raw
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgagtgcacctggtggagtcgtgggggagcttggtccagccgtggggggtccctgacgactctcctgtacngctctgggttctcttagtattatggatgacgtcggccncgaggcgtaccgggggaaggggccgaggtgggtggaccaacagtaatgacaaagagtaggaactagaaagaaaaacgtgtacggggtaacttcgtagtaggggaacgggccgtattacccaccctatcctacaagaacgaaaccctaaacgtaaacgtaaactttaactttcgttttaccaggaacctaaaagtcgaaacaagtcctaggaacgacggtaacccggagggaccacgggttgtagttagttagttacgtaggacggacgggaaggtcgtagggtcggtcgggtacgggacgtacggttacgggtaccgggttaacgggggaccggggtaacccggaacggggaccccggtaccggtcccgtacccggtccg

SEQ ID NO: 343862 - DNA, 749 bp, Homo sapiens
  misc_feature: GZ8MTXP02GF6TW.19.48.E04.1.454.CMB.2.raw
  modified_base (259)..(259): a, c, t, g, unknown or other
  misc_feature (259)..(259): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagctctcctgtacnggctcgtggttctctttagtagttagttgatgaacgtcgggccccgcgaggccgtaccgggggaaggggccggaggtggggtacgaccaaacgataagtgacaaagagtaggaaactaggaaaacgtaaaaacgtaggtacgggggtacttacggtaggtacggggaaacggggtacccgtaagtttacccgaacccgtatacccgtacccgaaaggaaacgtaaaccccgtaaaacccggttaaaaggtaaacccttttaaccgtttacgttttaccgtaaggtaaacctaaaagttacggaaaacctacggtacccgttaagggaacgggtaacccgggacccggaaacggggaccgaaccgggttcgttaggtttacgtttaagtttagtttcggagggaccggtaaagggcgtaggtcggcgtaggggactaggtcggacgttcggacgggggaccaaacggggaccgtacggtaccgaccgtccc

SEQ ID NO: 343863 - DNA, 699 bp, Homo sapiens
  misc_feature: GZ8MTXP02FKWP3.19.48.E04.1.454.CMB.2.raw
  modified_base (267)..(267): a, c, t, g, unknown or other
  misc_feature (267)..(267): n is a, c, g, or t
tcagtactctcgtgcacgaccggtgctcgatttagagagcgtcacagagagaagggggtctcagagaggagccttagccctggactccaaggccctttccacttggtgatcagcactgagcacagacgactcaccatggaattggggctgagctgggttttcctcgttggtattttagaaggtgtccagtgtgaggtgcaccgtggtggagtcgtgggggagcgttggtccaggccggtggggggtccctgagactctcctgtacgnggctcgtggttctctttagtagttatggatgaacgtcgggcccgcgagggcgtccgggggaggggccggaggtgggtcggaccaacataagtgacgaagataggaactagaaaagtaaaaaccgtaggtacggggtacttcgtaggtacggggaacgggcccgtaattacccaacctacgttaccaccgaaagaacgaaaccctaaaacgtaaacgtaactttacgttagttctagaaactaaatacgaacacgaccgtaggaacggtacggacccggaagggaaccgaacgggtctttaggtagtttaagtttagtagggtaggaacgggtaacgggcgtaagggtcggtaccggttaggggactaggtcggggtaacggttcgggacggggaaccgaaacggggaccctaccggtacccgacgttccccg

SEQ ID NO: 343864 - DNA, 669 bp, Homo sapiens
  misc_feature: GZ8MTXP02HC25R.19.48.E04.1.454.CMB.2.raw
tcagtactctcgtgcacgaccggtgctcgatttagagagcgtcacagagagaagggggtctcagagaggagccttagccctggactccaaggccttttccacttggtgatcagcactgagcacagacgactcaccatggaattggggctgagctgggttttcctcgttggtattttagagtgtccagtgtgagtgcaccgtggtggagtcgtgggggagtcgttggtccagccgtgggggtccctgacgtactctcctgtacagctcgtggttccttcgttagttagttattggatgaacgtcggcccgccgaggccgtacgggggagggccggagtgggtcgaccaaagataagtgacgaaagagtaggaactagaaagaaaaactggtagggactcgtagtgggaacgggcctagttaccacctatcctaccaagaacgaaaccctaaaccggtaaacgtaacttactttcgtttaccgtagaacctaaatacgaaacacgacctaggaaggacggaccgaacgggacgaaccggtgtaggttagtttaagttagttggtaggaccggtaaagggcgaagggttggcgtaggggtacgaggttacggggacgttcggggacgggaacccggaacgggaacccggacgggtacccgtaccggtccccg

SEQ ID NO: 343865 - DNA, 711 bp, Homo sapiens
  misc_feature: GZ8MTXP02JII3K.19.48.E04.1.454.CMB.2.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcgttggtccaggccgtgggggtccctgacgactctccgtgtacgnggcttcgtgggttctctttagtagttatggatgacgtcggcccncgnggcgtccggggagggccggaggtgggtgaccaactatagngacaagagtaggaactaggaaagtaaaacgtgtaggggactgttaggtgggaacgggaccgtattaccgaacctactacctacccgaaagacgtaaaccgtaaaacccgttaaagtaaccgttttacttacgtttacctaacgtaactaaagtacgaaacgtaccggtaccgtagggaacgacggacccggaaacgggaaccgtaccggggtattaggttaggtttaagtttagttagggtacggaaccgggtaaaggcgttaagggtcgggacgttaggggaacctagggtacggacgggttcggacgggggaacccgtaaacgggggacctaccgggtacccgtaacccggttccc

SEQ ID NO: 343866 - DNA, 683 bp, Homo sapiens
  misc_feature: GZ8MTXP02I1ZJ4.19.48.E04.1.454.CMB.2.raw
  modified_base (524)..(524): a, c, t, g, unknown or other
  misc_feature (524)..(524): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcaccgtggtggagtcgtgggggaggtcttggtccagccggtggggggtccctggagactctcctgtacaggctcgtgggttctcttagtagttatgatagacgtcggccgcgaggcgtccggggagggccggaggtgggtgaccaacataagtgacgaaagagtagggaactaggaaagaaaaaacgtgtacggggactcggtaggtaggaacgggcgtatccgaactactcctaccgagacgaaaccgtaaacgaaacgtaaacttacgttgttacagactaaaagtgaactacggcctaggacggagaccggaaggaaccgacggngtacggttattagttagtttggacgtaccggaagggtcgtaaggtcgggtaccggtaggggtaccaaggttcggggaacccgggttcgggtaccgggggaaacccggaaaccgggggtaccccgtaccgggggttaacccccgacccgtttacccccgg

SEQ ID NO: 343867 - DNA, 684 bp, Homo sapiens
  misc_feature: GZ8MTXP02FHZ6X.19.48.E04.1.454.CMB.2.raw
  modified_base (347)..(347): a, c, t, g, unknown or other
  misc_feature (347)..(347): n is a, c, g, or t
tcagtactctcgtgcacgaccggtgctcgatttagagagcgtcacagagagaagggggtctcagagaggagccttagccctggactccaaggccctttccacttggtgatcagcactgagcacagacgactcaccatggaattggggctgagctgggttttcctcgttggtatttagaggtgtccagtgtgaggtgcaccgtggtggagtcgtgggggagcttggtccagccgtgggggtccctgagactctctgtacagctcgtggttctctttagtagttatggataggaactcgggcccgcgagggccgtaccgggggaagggccggaggtggggtgacccaanaagtaaatgacaaagagtacggaactagaaacgtaaaaactggtaggggacctagtaggtacggaaacggggacctagttaccaacctaagtccgtaccgaaagacgaaaccgtaaaacccgtaaagtaaacgtttacgttacgtttactaggaaactaaagtacgaaactacgacccgtaggaacggacggaccggaaggaaccgacggtacgtaggttagttagttaagttggtacggacggaagggtacgtaggttaggccggtagggaacgtaggtcggtacggttcggacggggaccgaaacggggaccctacggtacccgaccggttcccg

SEQ ID NO: 343868 - DNA, 584 bp, Homo sapiens
  misc_feature: GZ8MTXP02FGIQL.19.48.E04.1.454.CMB.2.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
  modified_base (388)..(388): a, c, t, g, unknown or other
  misc_feature (388)..(388): n is a, c, g, or t
  modified_base (519)..(519): a, c, t, g, unknown or other
  misc_feature (519)..(519): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtattttagaaggtgtccagtgtgaggtgcacctggtggagtcgtgggggagcttggtccagccgtggggggtccctgagactctcctgacnggctctgggttctcctttagtagttattggatgaacgtgggccccncgaggcgtccgggggaaggggccggagtgggtggccaacataatgacaagatggaactgaaagaaaaactgtaggggactcgnggtggaaacggggccgtattccgaacctatcctccaagacgaaaccaaaccgtaaagaacttacttgttctgacaaatagaacagcctgagagcgaagggacacgggctagtgtattatgtgacggaggcnggtcggcgtagggacagtggacgtcggtcgggggaccaaacgggggccctacggcctacgtcccg

SEQ ID NO: 343869 - DNA, 783 bp, Homo sapiens
  misc_feature: GZ8MTXP02FZ1JR.19.48.E04.1.454.CMB.2.raw
  modified_base (270)..(270): a, c, t, g, unknown or other
  misc_feature (270)..(270): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagcttgggttttcctcgttggtattttagaaggtgtccagtgtgaggtgcacctggtggagtcgtgggggagtcgttgggtccgaggtccggtggggggtccctgacgacctctctgtacnggctcgttgggttctcctttagtagttattggatgacgtcggggccccgcgagggccgtaccggggggaacggggccggtagggtcggggtcggacccaaacgtattaaagtcggacgaaaaggagttaacggggaaacttaggaaaacgtaaaaaacgttgggtaggggtacttcggttgggttaggggaaccggggtaccgtatttacccgaacctaagtcccgtaccgagaaacgaaacccgtaaacccgttaaaagtaaccttttacgttagtttttaccacgaacctaaaagtacggaaaccacggtccctagggaacgaaccggccggaaaggggacccgaaccgggtgttaaggtttcgttaaatttacggttggtaacgggaccggtaaagggggtccgtaagggttcgggaccgggttgggaaactagggtcggggtaaccggttcggggacgggggaacccgtaaacgggggaccccgtaccggtacccgtaacccgttcccg

SEQ ID NO: 343870 - DNA, 756 bp, Homo sapiens
  misc_feature: GZ8MTXP02H6S22.19.48.E04.1.454.CMB.2.raw
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
tcagtactctcgtgcacgaccggtgctcgatttagagagcgtcacagagagaaggggtctcagagaggagccttagccctggactccaaggcctttccacttggtgatcagcactgagcacagacgactcaccatggaagttggggctgagcttgggttttcctgttggttattttagaaggtgtcagtgtgaggtgcacgtggtggagtcgtgggggagcgttggtccagccgtgggggtccctgagtactctcctgtacnggctcgtggttctctttagtagttagttgatgacgtggccncgnggcgtcggggaggcggagtggngacaanataagngacaagagtaggaactaggaaaacgtaaaaacgtggtacggggtacttacgttagggttacggggaaacgggtcccgtaaacgtttacccgaaaccgttactacccgtaaccgaaacggtaaaccgaaaacccgtaaaaccggttaaaacgttaaacgtttaaccgtttacgtttaccggtaagtaaaccgtaaaagtacgaaaactaggtacccgttaaggaaacggacggacccgggtaaacggggaaccgtaccggttacgtaggtttagttaacgtttaggtgggtaacggaacgggtaaacggggtgaacgggtgggtacggtagggtaccgtaagggttcgggaccggttcgggaccggggaaccgaaaaccgggggtcccgtaaaccgggtcctaaccccggtttcccg

SEQ ID NO: 343871 - DNA, 721 bp, Homo sapiens
  misc_feature: GZ8MTXP02IK2GO.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagtcgttggtccgagtccggtgggggtccctggacgtacctcgtcctgtacgaggtctcgtggttctcttagtagttatggatgacgtcggccgacgaggccgtacggggaacgggccggaggtggcgaccaagtataagtgacaagagtaggaactagaaacgaaaacgtggtacgggacttacgtagtacgggaaacgggacctacttaccgaacctacgtcctaccgaagtaacgaaaccgtaaaccggtaaattacttacgttgtttacaacgtaaactaaagtacgaaaccacggtaccgtagaaccggacgtaccggaacggaacctcgggtacttaggttaagttacgttaagtggtacggaaacgggtagggacgttaaggggtcgtaacgggtacgggtacgtaaacggggttcggtacccggggtaaggtaccgggggaaacccgtaaaacggggacccgttacccgggtacccgttaaccccgttccccgg

SEQ ID NO: 343872 - DNA, 609 bp, Homo sapiens
  misc_feature: GZ8MTXP02IQ40P.19.48.E04.1.454.CMB.2.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtatttagaggtgtcagtgtgaggtgcacgtggtggagtcgtgggggagtcttggccagccgtgggggtccctgagactctcctgacnggctgtgggttctcttagtgttatggatgacgtggcccncaggcgtcggggaggccggaggtggtcggacaacagtaatgacgaagctagggactagaacgtaaaacgtgtaggggacttcgtagcgggaaagggcctattccgaccgtattccgacccgaagacgaaccgaacccgtaaaagtacctttacgttcgtttccgaagacgtaaaatcgaaatcgaccgtgaacgttcggacccgaggtacccgaggtcttggtagtaagttnttcggngaccggtaaggcgtaggttcgcgtgggtaacgcgtacggtacgtcggacgggaaccgtacggccgtacgtcgacgtc

SEQ ID NO: 343873 - DNA, 651 bp, Homo sapiens
  misc_feature: GZ8MTXP02FWHXO.19.48.E04.1.454.CMB.2.raw
  modified_base (259)..(259): a, c, t, g, unknown or other
  misc_feature (259)..(259): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccagccgtgggggtccctgagactctcctgacnggctctgggttctcctttagtagttatggatgaacgtcgggaccccgccgaggccgtaccgggggaaggggccggaggtggggtggccaaacgataatgacaaagagtaggaactgaaagaaaaactagtacggggactcgtgtgggaacgggcctattaccgaccatcctaccgaagacgaaaccaaaccggtaaagtaactttacgttagtttctagactaaagtacgaaacagtacctagacgagaccggaagggaccacggtctgttagtatttgtgtaggacggaaagggtcgaagggtcgggacgttaggggactaggtcgggtacggtaacggtcgggggaacccgaaacgggggaccgtaaccggggtccaacccggtttcccg

SEQ ID NO: 343874 - DNA, 668 bp, Homo sapiens
  misc_feature: GZ8MTXP02FWKR2.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctgttggtattttagaggtgtccagtgtgaggtgcaccgtggtggagtcgtgggggaggcttggtccaggccgtgggggtccctgagactctcctgtacaggctcgtgggttctctttagtagttatggatgaactgggcccgcaggcgtccgggggaagggccggaggtggggtgccaacataagtgacaaagataggaactggaaaagaaaactagtacggggactcgtggtgggaaacgggccgtaattaccaacccgtatcctacccgaagtaacgaaccaaacccggttaaagaaacttttaccttggtttacctaggaacctaaaagtgaaacacggtacctaggaacgaggacccggaagggaaccacggtacttgtaggttaattagttcggtgacgaaaggggcaaggtgggacgttagggggaacctaggtcgggtaaccggtcgggtacgggggaccgaaaacgggggacccctaacgggtcccgaccggttcccg

SEQ ID NO: 343875 - DNA, 549 bp, Homo sapiens
  misc_feature: GZ8MTXP02FJ9NN.19.48.E04.1.454.CMB.2.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (524)..(524): a, c, t, g, unknown or other
  misc_feature (524)..(524): n is a, c, g, or t
  modified_base (543)..(543): a, c, t, g, unknown or other
  misc_feature (543)..(543): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggagcttgggtccagcctggggggtccctgagactctcctgtacaggctcgtgggttctcctttagtagttatggaatgaactgggccccacagggctccgggggaaggggcccggaggtgggtggccaacataangccaaagntgggaaacctggagaaaaactntggggactcngtgaacggggcnttcaccntctcanagacaactagactactgttctgacanganagtccagngaagccgagggacgacggtctgttagtattagttgtgacggaagggcaggngtcggngacgatggagtcgnggccgacggtacaccgtcnccgtcc

SEQ ID NO: 343876 - DNA, 742 bp, Homo sapiens
  misc_feature: GZ8MTXP02GISZ8.19.48.E04.1.454.CMB.2.raw
  modified_base (348)..(348): a, c, t, g, unknown or other
  misc_feature (348)..(348): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcacctggtggagtcgtgggggagcttggtccaggccgtgggggtccctgagactctctgtacaggctcgtggttctcttagtagttattggatgaacgtcgggccccgcgagggccgtcgggggaacggggccggaggtgggtcggaccaanataatgacaagagtacggaactagaaagaaaaactagtacggggactacgtgggtaggaaacggggccgtattaccaaccgtactccgtacccgaagaacgaaaccgtaaacccggtaaaacgtaacgtttaacgtttacgtttaccctaggaaacctaaagtacgaaacgtacggacccgttaagggaacgacgggacccgggaaacgggaaccgaacccgggtcgtttagggttaaggtttaatttacggtttagggtgggtaaccggggaaaaggggtccgtaaagggtgggtacggttagggaccgtaagggttcgggaaccggtttccgggacgggggaaccgtaaaccgggggaccctaaccggggtttcccgaaccccggtttcccg

SEQ ID NO: 343877 - DNA, 728 bp, Homo sapiens
  misc_feature: GZ8MTXP02H9O5D.19.48.E04.1.454.CMB.2.raw
  modified_base (311)..(311): a, c, t, g, unknown or other
  misc_feature (311)..(311): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagcttggtccaggccgtgggggtccctggagtactctcctgtacaggtctcgtgggttcttcctttagtagttatggatgaacgtgggccccncgaggccgtaccgggggaagggccggaggtgggtcgaccaacagtaatgacaaagtagtacggaaactaggaaaagtaaaacgtggtacggggaacttcggtaggtgggaaacggggtacctacttaccgaacctactaccgtacccaaaggaacgaaaccctaaacgggttaaactaacctttaacgttcgtttttacgacgtaactaaaagttccggaaataccggaccgttaagggaacgaccgggaaccccgggaagggaacccgccggtagttaggttgttaaactttggttaggagggtaaccggaaaggggcctaaaggggttcgaccgtaggggtacaaggttcggggtaacgttccggggacggggacccgttaaaacggggccctaccgggtttcaccccgtttccg

SEQ ID NO: 343878 - DNA, 871 bp, Homo sapiens
  misc_feature: GZ8MTXP02FVSAP.19.48.E04.1.454.CMB.2.raw
  modified_base (260)..(260): a, c, t, g, unknown or other
  misc_feature (260)..(260): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggtttcctcgttggtatttagaaggtgtcagtgtgaggtgcaccgtggtggagtcgtgggggagtcgttggtccagccggtgggggtcctgagactctcctgtacngctcgttgggttctcgtttagtagttagtgagtgaacgtcgggccccgacgacgggccgtacgggggaacggggcgggtaggtggggtacggaccgaacgaagtaaacgtacggacaaagagtacggaaacgtaacggaaaacgtaaaaaccgttaggtagggggtaacctttaccggtagggtacggggaaacgggggacccgtaacgtttacccgaacccgtaacttacccgttaaccggaaacggtaaaacggtaacccgtaaaaacccgggtaaacgttaaaacccgtttacgtttacgtttaccgttaacgtaaaccgtaaaagttaaccgtaaacgaaaccggtccgttaaacggaaagggaacccgggtaccgggaaaaccgggtaaccgaacccggggttaccgtttaggggttacgttttaaacgtttgggtttaaacgggtcggggtaaacccggggttaaaaggggacgtaaaccgggggtgggtaaccgggttaaggggaccgttaaggggtcggttacgggtaaccggggttacccgggggaaccgggaaaaccgggggtacccgtaacccgggttacccgtacccggtttaccccgg

SEQ ID NO: 343879 - DNA, 723 bp, Homo sapiens
  misc_feature: GZ8MTXP02H4EX0.19.48.E04.1.454.CMB.2.raw
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagtcttggtccaggtccgttggggggtccctggacgacctctccgtgtacgaggtctcgtggttcttcgtttagtagttattggatgaacgtcgggccccgcgaggccgtaccgggggagggccggaggtgggtcgaccaaacataagtgacaaagagtaggaactagaaagaaaaacgtggtacggggtacttcgtaggtgggaacgggaccgtacgttaccgaaccgtacttacctacccgtaaagaacgaaacccgtaaaaccggtaaaacgttaaacctttacgtttacggtttttacccaggaaacctaaaagtcggaaacacggtaccgtaggaacggacggacccggaggacccgacggtcgttaggttgtagtttacgtggtacggaacggtaacgggcgtaaggtcgggtaccgaggggtaactaggtaccggtacgtaacgggtaccggggaacccgtaaacggggaccccgtaccgggtccaacccggtttccc

SEQ ID NO: 343880 - DNA, 680 bp, Homo sapiens
  misc_feature: GZ8MTXP02F1UF4.19.48.E04.1.454.CMB.2.raw
  modified_base (544)..(544): a, c, t, g, unknown or other
  misc_feature (544)..(544): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtatttagaaggtgtccagtgtgaggtgcaccgtggtggagtcgtgggggaggtcgttggtccagccgtcgggggtccctgagctctcctgtacaggctcgtggttctctttagtagttatggatgaacgtggcccgcgaggcgtccggggaagggccggaggtgggtcggaccaacgaatagtgacaagagtacggaactagaaaagaaaacgtagtacggggtactcgtaggtacgggaacgggtccgtaattacccaacctactaccgtaccaagtaaccgaaccaaaacgttaaacgtactttaacgttgttacagtaaacgaaactagaaccagcccgtagaagggaccgccgggaaacggacgtaaccgngttaggttagttattagttcgggaacgtacggggaaagtcggaaggtcgggtacggtagggaaccttagggtccggtacggtaacgggccggggacccgaaaacggggccctaacggggtcccctaacggtccccg

SEQ ID NO: 343881 - DNA, 779 bp, Homo sapiens
  misc_feature: GZ8MTXP02F0Y9K.19.48.E04.1.454.CMB.2.raw
  modified_base (293)..(293): a, c, t, g, unknown or other
  misc_feature (293)..(293): n is a, c, g, or t
tcagtactctcgtgcacgaccggtgctcgattttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggagtcttggtccagccgtggggggttccctgagtacctctcctgtacaggcttcgtgggttctctttagtagttnttgatgaacgtcggcccgacgacggcggtaccgggggagggccggaggtcggggtcggaccaacagtaacgtcgacgaaagagtaggaaactaggaaaacgtaaaaatacggtggggtaacttcgttagggtaggggaacggggtaccctaatttacccgaacctatacccgtaccgaaaggaacgtaaaacccgtaaaacccggtaaaacggttaaactttaacttacgtttacctaaggaactaaaacgttaacgaaaccgtaggacccttaagggaacggtaacggacccgggtaacgggaaccgaaccggtgtttaggttaagttaagttttaggtagggtgggttaaccggtaaaagggccggttaagggtcgggttaccgggaaccgggttaacgaaggtccgggtaacggtgggggtaccccgggggaacgtaaaacccgggggcccggtaacccggttccgtaaccccgtttccccgg

SEQ ID NO: 343882 - DNA, 767 bp, Homo sapiens
  misc_feature: GZ8MTXP02IODZD.19.48.E04.1.454.CMB.2.raw
  modified_base (310)..(310): a, c, t, g, unknown or other
  misc_feature (310)..(310): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgagtgcacctggtggagtcgtgggggagtcttggtccagtccgtgggggtccctggagactctccgtgtacaggtctcgtgggttctccgtttagtagttatggatgaacgtcgggcccncgaggccgtcgggggaacgggccggaggtgggtcgaccaaacgataatgacaaagagtaggaactagaaagaaaacgtgtaggggactgtgtaggaacgggtcctagttaccaaccgtataccgtacccgaagaacgaaacccgtaaaacccggtaaagtaaaccgtttaacgtttacggtttacctaggtaactaaaacgttacgaaacgaacggtcccgttaaggaaaggtaccggaacccgggtaacgggaaccgtaaacccggggtctttacgggttaacggtttaacttttaaacggttcggttaagggaaccggggttaaaacgggggtacggttaggggttacgggtacggttacggggtaaccgtacgggttacgggtaccgggtccggggtaaccggggaaccggaaacccggggtacccgtacccgggtacccgttacccggtcccg

SEQ ID NO: 343883 - DNA, 595 bp, Homo sapiens
  misc_feature: GZ8MTXP02HU9QN.19.48.E04.1.454.CMB.2.raw
  modified_base (302)..(302): a, c, t, g, unknown or other
  misc_feature (302)..(302): n is a, c, g, or t
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattgggctgagctgggttttcctcgttggtattttagaaggtgtcagtgtgaggtgcacgtggtggagtcgtgggggagcttggtccagccgtgggggtcctgagactctcctgtacaggtctcgtggttctccttagtagttattggatgaacgtggacccncgaggcgtaccggggaagggccggagtggtggaccaacagtaaatgacaaagataggaactagaaagtaaaaaacgtgtacggggatcgttagnggaaagggcccaagttcaaccctnacgtaccagaaanaacaaacgtaaataacttaacttatttactatacaaaananaacgacgacagagacgacgacgaacgacgagtagtagtattagtagtagaggacggagagtcgtgtacgacgacgtagtagtaacggacggacggaacggaccgtacgtacgtaccgtccg

SEQ ID NO: 343884 - DNA, 679 bp, Homo sapiens
  misc_feature: GZ8MTXP02J0XEK.19.48.E04.1.454.CMB.2.raw
  modified_base (565)..(565): a, c, t, g, unknown or other
  misc_feature (565)..(565): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgaactcaccatggaattggggctgagctgggttttcctcgttggtattttagaaggtgtccagtgtgagtgcacctggtggagtcgtgggggagtcttggtccagccgtgggggcacgtgagactctcctgtacagctcgtggttcctccgtttagtacttacttggatgaacgtggccccgcgaggtccggtccggggaaggggcccggaggtcggggtacggccaactagtaattcgacaaaggataggaacctaggaaacgaaaaacttggtcggggaactcgttgggtagaaacggggtccgtacttcgaccctaatccctacccaaggaacggaactaaaacccggtaacgtaaaccgtttacgtttacgttacgttagaaccttaaaagtcgaaaactcggacctaggaggaccgacgaaggttacgaccggntagtacggttaattagtggtacggacgtaaagggggtcaaggttcgggacgtaggggaaacctggtacggtaacgtacgggacgggaaccggaaccggtccgacggtcccacgg

SEQ ID NO: 343885 - DNA, 696 bp, Homo sapiens
  misc_feature: GZ8MTXP02G4NLM.19.48.E04.1.454.CMB.2.raw
  modified_base (263)..(263): a, c, t, g, unknown or other
  misc_feature (263)..(263): n is a, c, g, or t
  modified_base (596)..(596): a, c, t, g, unknown or other
  misc_feature (596)..(596): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcaccgtggtggagtcgtgggggagcgttggccagccgttgggggtccctggagactctcctgtacnggctgtgggttactcgttagtagttatggatgaccgtggcccaccgaggcgtaccgggggacgggcggaggtgggcgaccaaacagtaatgacaaagacgtagggaactaggaaagaaaaaccgtgtacggggtactacgttgggacgggtaacggggcctaagttaccaacccgtatcccgacgaaagggaacaaaccgtaaaacccgtaaggtaaaccctttacgttacggtttcaacggtaactaaaagacgtaaaccgacgtcccgtaaagagggaacgttaccccggaagggtaaccacggtcttggtacgttaagttcgtggtacgngggtaaagggctagggtacggagtaagggcaaggtcgggtacgaacgggttacggggaacccggaacgggttaccgaaccgggtccctaaccggttcccg

SEQ ID NO: 343886 - DNA, 659 bp, Homo sapiens
  misc_feature: GZ8MTXP02F6HT3.19.48.E04.1.454.CMB.2.raw
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (430)..(430): a, c, t, g, unknown or other
  misc_feature (430)..(430): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtcagtgtgaggtgcactggtggagtcgtggggagcttggtccaggccgtggggggtccctgagactctacctgtacagctcgtggttctcctttagtattatggatgaactggccccncgaggctcgggggagggccgagtgggngaccaacagtaatggacaaagataggaaactgaaagaaaactagtacggggactcgtaggttgaacggggaccaattaccaccgtaagttccaccaaggtanaaacctaaaccggtaaataacctttacgttatttaccgagaacctaaaagtcgaaaccgtagacccgtaggaaacggtacgacccggaaagggttacccaaacggggttctaggtgttaaatttagtacggtgaaccggtaaaggtcgaaggtcgggaccttgggacgaattccgggaagttcccggtggggacccaaaacgggggtccaacggggtcccaaccggttc

SEQ ID NO: 343887 - DNA, 736 bp, Homo sapiens
  misc_feature: GZ8MTXP02FG7DU.19.48.E04.1.454.CMB.2.raw
  modified_base (318)..(318): a, c, t, g, unknown or other
  misc_feature (318)..(318): n is a, c, g, or t
tcagtactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtcgtgggggaggcttggtccagccgtggggggtccctgagactctcctgtgcacgcctctggacttcactttgatgattatcgcctatcgacacgtcggggtcccgganaacggcctacccggaaggggaacggggtcccgtaggggtacggttcggggtaccttacggtaaggggttagtttacggtttaggggaaattaggtggtacttaagggttactaacggtacccttaagttcgggaccgggtactcgtagggtacggggtaaacgggtcccgtagtttacccaaccctacgttaccgtcccaaagggaacggaacccaaaaccggtaccctaaaaacggtaccctacccgttacgttaacgtaccttagggaactaaaacgtacgaaaacctaggtaccgtaggaacggacgtacgtaggggaaccggtaccgggtaaccggttacccgttaggttaactttaccgtggtacgaacggtaaaaggggtacgttaagtactacgaacgtccgtttaacggg

SEQ ID NO: 343888 - DNA, 447 bp, Homo sapiens
  misc_feature: GZ8MTXP01DP4SN.3.41.D08.1.454.CMB.2.raw
  modified_base (443)..(447): a, c, t, g, unknown or other
  misc_feature (443)..(447): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagaccagaggacacggctgtttattactgtgcgagagaaacttacgatttttggagtggttattatactccccgggatcttgactactgggccaggggaccctggtcaccgtctcctcagcttccaccaaagggccccatcggtccttccccctggcgcccctgctccaggagcacctctcgggggcacagcggccctgggctgcctggtcaaggactacttccgagtgcgtctctgagcgggctggcaaggcgcatagnnnnn

SEQ ID NO: 343889 - DNA, 445 bp, Homo sapiens
  misc_feature: GZ8MTXP01AX2GD.3.41.D08.1.454.CMB.2.raw
  modified_base (437)..(445): a, c, t, g, unknown or other
  misc_feature (437)..(445): n is a, c, g, or t
tcagagacgcactccacgaccggtgctcgatttagtcacgcgagaaagggaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaaggcccatcggtctccccctggcgccctgctccaggagcacctctgggggccacagcggccctgggctgccctggtcaagggctacttccgagtgcgtctctgagcgggctggcaaggcgcatagnnnnnnnnn

SEQ ID NO: 343890 - DNA, 458 bp, Homo sapiens
  misc_feature: GZ8MTXP01BSYRF.3.41.D08.1.454.CMB.2.raw
  modified_base (340)..(340): a, c, t, g, unknown or other
  misc_feature (340)..(340): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(458): a, c, t, g, unknown or other
  misc_feature (447)..(458): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctgggtcaccgtctcctcagcttccaccaagggccccatcggtctccccctggcnccctgcctccaggagcacctctgggggcccacagcggccctgggctgcctgggtcaaggctactccggagtcgcgtctcgtgagcgggctgggcaaggccganangnnnnnnnnnnnn

SEQ ID NO: 343891 - DNA, 438 bp, Homo sapiens
  misc_feature: GZ8MTXP01B5GM7.3.41.D08.1.454.CMB.2.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (430)..(438): a, c, t, g, unknown or other
  misc_feature (430)..(438): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggcaccgtctcctcagctccaccaaggcccatcgtctcccctgcnccctgctccagancactcnggggccacagcggccctgggctgcctggtcaagggctacttccgagtgcgtctctgagcgggctggcaaggcgcgatagnnnnnnnnn

SEQ ID NO: 343892 - DNA, 443 bp, Homo sapiens
  misc_feature: GZ8MTXP01AQJ8P.3.41.D08.1.454.CMB.2.raw
  modified_base (436)..(443): a, c, t, g, unknown or other
  misc_feature (436)..(443): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgattttggagtggttattatactcccgggatcttgactactggggccaggggaccctggtcaccgtctcctcagcttccaccaaggcccatcgtctcccctggcgccctgctccaggagcacctctgggggccacagcggccctggggctgcctgggtcaagggctacttccgagtgcgtctctgagcgggctgggcaaggcgcatagnnnnnnnn

SEQ ID NO: 343893 - DNA, 443 bp, Homo sapiens
  misc_feature: GZ8MTXP01DEF8Y.3.41.D08.1.454.CMB.2.raw
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (434)..(443): a, c, t, g, unknown or other
  misc_feature (434)..(443): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagctccaccaaggcccatcgtctccccngcnccctgctcaggagcacctctgggggccacagcggccctgggctgcctggtcaagggactacttccgagtgcgtctctgagcgggctggccaaggcgcatagnnnnnnnnnn

SEQ ID NO: 343894 - DNA, 447 bp, Homo sapiens
  misc_feature: GZ8MTXP01COGM7.3.41.D08.1.454.CMB.2.raw
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
  modified_base (435)..(437): a, c, t, g, unknown or other
  misc_feature (435)..(437): n is a, c, g, or t
  modified_base (439)..(447): a, c, t, g, unknown or other
  misc_feature (439)..(447): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactgggggccaggggaccctggcaccgtctcctcagcttccaccaaggcccatcgtctcccctgcgcctgctcaggancactctggggccacagcggccctgggctgcctggtcagggactacttccgagtcgcgtctctcgagccgggntgggcaaggcgcagtagnnngnnnnnnnnn

SEQ ID NO: 343895 - DNA, 448 bp, Homo sapiens
  misc_feature: GZ8MTXP01A33J8.3.41.D08.1.454.CMB.2.raw
  modified_base (441)..(448): a, c, t, g, unknown or other
  misc_feature (441)..(448): n is a, c, g, or t
tcagagacgcactccacgaccggtgctcgatttagtcacgcgagaaagggaaagggctggaatgggttgcatacatttcaagtagtggttccaccatacattatgtagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcaccgagcggccctgggctgccctggtcaagggctacttccgagtgcgtctctgagcgggctggcaaggcgcatagnnnnnnnn

SEQ ID NO: 343896 - DNA, 439 bp, Homo sapiens
  misc_feature: GZ8MTXP01A9B76.3.41.D08.1.454.CMB.2.raw
  modified_base (347)..(347): a, c, t, g, unknown or other
  misc_feature (347)..(347): n is a, c, g, or t
  modified_base (427)..(427): a, c, t, g, unknown or other
  misc_feature (427)..(427): n is a, c, g, or t
  modified_base (433)..(439): a, c, t, g, unknown or other
  misc_feature (433)..(439): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagaaacttacgatttttggagtggttattatactccccgggatcttgactactggggccaggggaccctggcaccgtctcctcagctccaccaaggcccatcggtcttccccctggcgccctgctcaggancacctctgggggccacgagcggccctggctgcctggtcaagctacttccgagtcgcgtctctgagcgggctggcaaggcncatagnnnnnnn

SEQ ID NO: 343897 - DNA, 464 bp, Homo sapiens
  misc_feature: GZ8MTXP01A8XBG.3.41.D08.1.454.CMB.2.raw
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
  modified_base (455)..(464): a, c, t, g, unknown or other
  misc_feature (455)..(464): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggcaccgtctcctcagcttccaccaagggcccatcggtcttccccctggcgccctgctccaggancacctcgtgggggcccacaggcggccctggggcctgccctgggtaccaagggtacctacgttccggagtcgcgtctctgagcgggctgggcaagggcncatagnnnnnnnnnn

SEQ ID NO: 343898 - DNA, 439 bp, Homo sapiens
  misc_feature: GZ8MTXP01CBWD8.3.41.D08.1.454.CMB.2.raw
  modified_base (434)..(439): a, c, t, g, unknown or other
  misc_feature (434)..(439): n is a, c, g, or t
tcagagacgcactccacgaccggtgctcgatttagtcacgcgagaaagggaagggctggaatgggttgcatacatttcaagtagtggttccaccatacattatgcagactctgtgaagggcagattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaaggcccatcggtctcccctgcgccctgctccaggagcacctcgtcgggggcacagcggccctgggctgcctgggtcaaggctacttccgagtgcgtctctgagcgggctggcaaggcgcatagnnnnnn

SEQ ID NO: 343899 - DNA, 449 bp, Homo sapiens
  misc_feature: GZ8MTXP01C9ZAB.3.41.D08.1.454.CMB.2.raw
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (444)..(449): a, c, t, g, unknown or other
  misc_feature (444)..(449): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagttggttattatacctccccgggatcttgactactgggggccagggggaccctgggcaccgtctcctcagcttccaccaagggccccatcggtcttcccccnggcnccctgctcaggancactnggggccacagcgccctggctgcctggtcaagggctactccgagtcgcgtctcgtgaggcgggctgggccaagggcgacatgnnnnnn

SEQ ID NO: 343900 - DNA, 445 bp, Homo sapiens
  misc_feature: GZ8MTXP01DVAQJ.3.41.D08.1.454.CMB.2.raw
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (437)..(437): a, c, t, g, unknown or other
  misc_feature (437)..(437): n is a, c, g, or t
  modified_base (440)..(445): a, c, t, g, unknown or other
  misc_feature (440)..(445): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccggatcttgactactggggccaggggaccctggtcaccgtctcctcagcttccaccaagggccccatcgtcttcccctgcgccctgctccaggngcaccnctgggggccacgagcggccctgggctgcctggcaaagggactacttccgagtcgcgtctctgagcgggctggcaaggcgcanagnnnnnn

SEQ ID NO: 343901 - DNA, 487 bp, Homo sapiens
  misc_feature: GZ8MTXP01AMKZ5.3.41.D08.1.454.CMB.2.raw
  modified_base (359)..(359): a, c, t, g, unknown or other
  misc_feature (359)..(359): n is a, c, g, or t
  modified_base (437)..(437): a, c, t, g, unknown or other
  misc_feature (437)..(437): n is a, c, g, or t
  modified_base (469)..(470): a, c, t, g, unknown or other
  misc_feature (469)..(470): n is a, c, g, or t
  modified_base (472)..(487): a, c, t, g, unknown or other
  misc_feature (472)..(487): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagttggttattatactccccgggatcttgactactggggccaggggaccctggcaccgtctcctcagcttccaccagggccccatccggtcctccccctggccgcccctgcctccagggacncacctcgtcgggggccacaggccgggcccctggggccctggccctggtcaaagggactacgttccggagtcgcgttcnctgacggcgggctgggcaagggcacgagtagnngnnnnnnnnnnnnnnnn

SEQ ID NO: 343902 - DNA, 453 bp, Homo sapiens
  misc_feature: GZ8MTXP01BDKQJ.3.41.D08.1.454.CMB.2.raw
  modified_base (445)..(453): a, c, t, g, unknown or other
  misc_feature (445)..(453): n is a, c, g, or t
tcagagacgcactccacgaccggtgctcgatttagtcacgcgagaaagggaaagggctggaatgggttgcatacatttcaagtagtggttccaccatacattatgtagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactacgtggggccaggggaccctggtcaccgtctcctcagcttccaccagggccccatcggtcttccccctggcgcccctgcctccaggagcacctctgggggcaccgagcggccctgggctgcctggtcaagggctactccgagtgcgtctctgagcgggctgggacaagggcgcatagnnnnnnnnn

SEQ ID NO: 343903 - DNA, 503 bp, Homo sapiens
  misc_feature: GZ8MTXP01B4SJE.3.41.D08.1.454.CMB.2.raw
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(503): a, c, t, g, unknown or other
  misc_feature (487)..(503): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagttggttattatactccccgggatcttgactacgtggggccaggggaccctggcaccgtctcctcagctccaccgaacggccccatccggtccttccccctggccgcccctgcctccgaggacgccaccgtcgtcgggggcccacgaggccggcccgtggggcctcggcccgtggtaccgaaacgggtaccttaccgttccggagtcgcgtctcgtggacgcgggcgtagggcgaagggccgangngnnnnnnnnnnnnnnnnn

SEQ ID NO: 343904 - DNA, 583 bp, Homo sapiens
  misc_feature: GZ8MTXP01BXL51.3.41.D08.1.454.CMB.2.raw
  modified_base (565)..(565): a, c, t, g, unknown or other
  misc_feature (565)..(565): n is a, c, g, or t
  modified_base (567)..(569): a, c, t, g, unknown or other
  misc_feature (567)..(569): n is a, c, g, or t
  modified_base (571)..(583): a, c, t, g, unknown or other
  misc_feature (571)..(583): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctaacaaatgaacagcctgacgacccgaggacacggtcttgtttattactgtgcgaagaagtaaacttacgtatttttggagttgttattatacctcccgggtatcttgactacgtcggggccgaggggacctggtccaccgtctcctcacgtccttaccaccgacgggcccctagtcccggtttccccttccccccgtgggccccgtccccgtcgtcccgtacccgaacgggaccgtcccgtacccgttccgggtacggggggccccccaaccggacgggccccggggtccccggttggggcccgttcggcccggttgggtacccgaaacgggttacccttaccggttccgggagtcgtccgttctacggtggcgggcgggcgtcggacgacggcgcagngnnngnnnnnnnnnnnnn

SEQ ID NO: 343905 - DNA, 508 bp, Homo sapiens
  misc_feature: GZ8MTXP01ELLUQ.3.41.D08.1.454.CMB.2.raw
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
  modified_base (490)..(492): a, c, t, g, unknown or other
  misc_feature (490)..(492): n is a, c, g, or t
  modified_base (494)..(508): a, c, t, g, unknown or other
  misc_feature (494)..(508): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgacgacccgaggacacggcttgtttattactgtgcgagagaaacttagtattttggagtggttattatacctcccgggatcttgactacgtggggccgaggggaccctggcaccgtctcctcagcttacccaccgaacgggccccagtccggtccttcccccgtggccnccctgcctccgaggcncaccgtcgtcgggggcccacgngccggcccgtcgggctcggccgtgggtaccaaagggtccttacgttccggagttcgcgtcctcgtggacggccgggcgtcgggacgaacgggcgcagtagnnngnnnnnnnnnnnnnnn

SEQ ID NO: 343906 - DNA, 461 bp, Homo sapiens
  misc_feature: GZ8MTXP01BV1CV.3.41.D08.1.454.CMB.2.raw
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (453)..(461): a, c, t, g, unknown or other
  misc_feature (453)..(461): n is a, c, g, or t
tcagagacgcactccacgaccggtgctcgatttagtcacgcgagaaagggaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagtggttattatactccccgggatcttgactacgtggggccaggggaccctggcaccgtctcctcagcttccaccaggcccatcggtctccccctggcgccctgcctccaggcncacctcgtgggggcccacgagccggccctggggcctgcccgtggtccaagggcctacttccggagtgcgtctctgnggcgggntagggcaagggcgcatagnnnnnnnnn

SEQ ID NO: 343907 - DNA, 500 bp, Homo sapiens
  misc_feature: GZ8MTXP01CCOK7.3.41.D08.1.454.CMB.2.raw
  modified_base (341)..(341): a, c, t, g, unknown or other
  misc_feature (341)..(341): n is a, c, g, or t
  modified_base (470)..(470): a, c, t, g, unknown or other
  misc_feature (470)..(470): n is a, c, g, or t
  modified_base (472)..(473): a, c, t, g, unknown or other
  misc_feature (472)..(473): n is a, c, g, or t
  modified_base (475)..(500): a, c, t, g, unknown or other
  misc_feature (475)..(500): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagttggttattatacctcccgggatcttgactacgtggggccaggggacccctggcaccgtctcctcagcttccaccaagggccccatccggtccttcccccgnggccgccctgctccgaggagcacctcgtgggggcccacgagccggccctgggctgccgtggtccgaaaggctacttccggagtcgcgtctcgtgacggcgggcgtgggccgaagggccgcgagtacggngnngnnnnnnnnnnnnnnnnnnnnnnnnnn

SEQ ID NO: 343908 - DNA, 605 bp, Homo sapiens
  misc_feature: GZ8MTXP01CUEGQ.3.41.D08.1.454.CMB.2.raw
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(605): a, c, t, g, unknown or other
  misc_feature (583)..(605): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagaccgaggacacggcttgtttatactgtgcgagaagtaaacttagtatttttggagttggttattataccgtccccgggattcttgactacgtcggggccgacggggaccctggccacccgtcctcctcacgctcccaaccgaacggccccactcccggtcccttcccccgtcggccgtcccctcgtcctcccgagggacgcctacccgtccggtcggggggacccccaacggacgggcccgggtccccggtcgggggtcccgttcgggtccccgttacggggtaaccgaaaccggggtaacccctttacccggtttaccccgggaaggttccggtcccgttccgtcggtcgggacgggccggggccggtgggacccgaagggccgacagtagngnngnnnnnnnnnnnnnnnnnnnnnnn

SEQ ID NO: 343909 - DNA, 444 bp, Homo sapiens
  misc_feature: GZ8MTXP01BQH3M.3.41.D08.1.454.CMB.2.raw
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (434)..(434): a, c, t, g, unknown or other
  misc_feature (434)..(434): n is a, c, g, or t
  modified_base (437)..(444): a, c, t, g, unknown or other
  misc_feature (437)..(444): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactacgtggggccaggggaccctggcaccgtctcctcagctccacaaggcccatcgtctcccctgcncctgctcaggancactcgtggggccacgagcggccctgggctgccgtggtcaaggactacttccgagtcgcgtctcgtgacgcgggctggccgaaggcgcanagnnnnnnnn

SEQ ID NO: 343910 - DNA, 517 bp, Homo sapiens
  misc_feature: GZ8MTXP01A5NJ8.3.41.D08.1.454.CMB.2.raw
  modified_base (382)..(382): a, c, t, g, unknown or other
  misc_feature (382)..(382): n is a, c, g, or t
  modified_base (474)..(474): a, c, t, g, unknown or other
  misc_feature (474)..(474): n is a, c, g, or t
  modified_base (504)..(517): a, c, t, g, unknown or other
  misc_feature (504)..(517): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttatactgtgcgagagtaaacttacgtagtttttggagttggttattataccgtcccggtattctgactcgtcggggccgagggtaccctggccaccgtcctctcacgtcctaccaccgaacggcccctagtccggtcccttcccccgtgcccgtccccgtgccctccgagggacnccgaccgtcggtcgggggccccacgacggcccggtcccgtcggggcctcggccgtgggtacgaacggtccttacgtccgagtcgtcgtctgnggcgcgggtcgtcggcgaacggcacagagnnnnnnnnnnnnnn

SEQ ID NO: 343911 - DNA, 457 bp, Homo sapiens
  misc_feature: GZ8MTXP01D7QBP.3.41.D08.1.454.CMB.2.raw
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (440)..(442): a, c, t, g, unknown or other
  misc_feature (440)..(442): n is a, c, g, or t
  modified_base (444)..(457): a, c, t, g, unknown or other
  misc_feature (444)..(457): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgacgacccgaggacacggctgtttattactgtgcgagagtaaacttacgtatttttggagttggttattatactcccgggatcttgactacgtggggccaggggaccctggcacgtctcctcagctccacgaaggcccatcgtcctccccngcncctgctcagcncacctgngggccacgngccgccctggctgcctgtcaaggctacgtccgagtcgcgtctcgtggacgcgggtctgggacaagggcgacagtagnnngnnnnnnnnnnnnnn

SEQ ID NO: 343912 - DNA, 461 bp, Homo sapiens
  misc_feature: GZ8MTXP01APYY6.3.41.D08.1.454.CMB.2.raw
  modified_base (365)..(365): a, c, t, g, unknown or other
  misc_feature (365)..(365): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (453)..(461): a, c, t, g, unknown or other
  misc_feature (453)..(461): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagaaacttacgatttttggagtgttattatactccccgggatcttgactacgtggggccaggggaccctggtccaccgtctccgtcagcttccaccaagggcccatccggtcttccccctgccgcccctgcctccaggcgcacctcgngggggccacgagcggccctgggctgcccgtggcaaagggcctacttccggagtcgcgtctctgagcgggntgggcaaggcacgntagnnnnnnnnn

SEQ ID NO: 343913 - DNA, 461 bp, Homo sapiens
  misc_feature: GZ8MTXP01DR3ZH.3.41.D08.1.454.CMB.2.raw
  modified_base (328)..(328): a, c, t, g, unknown or other
  misc_feature (328)..(328): n is a, c, g, or t
  modified_base (449)..(451): a, c, t, g, unknown or other
  misc_feature (449)..(451): n is a, c, g, or t
  modified_base (453)..(461): a, c, t, g, unknown or other
  misc_feature (453)..(461): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccggatcttgactactggggccaggggaccctggcaccgtctcctcagctccacaggccatcgtctcccctgcncctgctccaggacgcacctcgtgggggccacgagccggccctgggcctgccctgggtccaagggacctacgttccggagtcgcgtctcgtggagccgggcgtggccgaaggcgacagtagnnngnnnnnnnnn

SEQ ID NO: 343914 - DNA, 628 bp, Homo sapiens
  misc_feature: GZ8MTXP01AIXUO.3.41.D08.1.454.CMB.2.raw
  modified_base (596)..(598): a, c, t, g, unknown or other
  misc_feature (596)..(598): n is a, c, g, or t
  modified_base (600)..(628): a, c, t, g, unknown or other
  misc_feature (600)..(628): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttattactgtgacgagaagtaaactttacgtagtttttggagttagttattataccgtccccgggtattcgttgacgtacgtcggggccgacggggaccctggccaccgtcctcctcacgtccttacccgaaccgtaacgggcccctagttccccggttccccttccccccgtgggcccctccccgtcgacccttcccggaaggccgcccgtaccgtcgggtcggggggaccccaccgggacggcccggtccccggtggggacccgtccgggtcccgttggggtaacccgaaacggggtaccctttacccggttcgggacggttcgccgtttccgtcggtagggacgggtccggggtcggtacgggacgaacgggggcccgaagaagtgnnngnnnnnnnnnnnnnnnnnnnnnnnnnnnnn

SEQ ID NO: 343915 - DNA, 522 bp, Homo sapiens
  misc_feature: GZ8MTXP01EKZXZ.3.41.D08.1.454.CMB.2.raw
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (487)..(487): a, c, t, g, unknown or other
  misc_feature (487)..(487): n is a, c, g, or t
  modified_base (492)..(494): a, c, t, g, unknown or other
  misc_feature (492)..(494): n is a, c, g, or t
  modified_base (496)..(522): a, c, t, g, unknown or other
  misc_feature (496)..(522): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttatactgtgacgagagtaaacttagtattttggagttgttattatacgtcccgggatcttgactacgtggggccgaggggaccctggcaccgtctcctcacgtctccacaacggcccatccgtcttccccctggccnccctgcctacgaggtcnccgtaccgtggtcgggggcccacgacggccggtcccgtgggcctcgccgtggtaccgaaacgggtacttacccgtcggagttcgccgtctcgtggacggccgggcgtacgggcgaaagggcccaanagagnnngnnnnnnnnnnnnnnnnnnnnnnnnnnn

SEQ ID NO: 343916 - DNA, 571 bp, Homo sapiens
  misc_feature: GZ8MTXP01C7NCX.3.41.D08.1.454.CMB.2.raw
  modified_base (366)..(366): a, c, t, g, unknown or other
  misc_feature (366)..(366): n is a, c, g, or t
  modified_base (479)..(479): a, c, t, g, unknown or other
  misc_feature (479)..(479): n is a, c, g, or t
  modified_base (534)..(534): a, c, t, g, unknown or other
  misc_feature (534)..(534): n is a, c, g, or t
  modified_base (540)..(542): a, c, t, g, unknown or other
  misc_feature (540)..(542): n is a, c, g, or t
  modified_base (544)..(571): a, c, t, g, unknown or other
  misc_feature (544)..(571): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcacgtctccagagacaacgcccagaactcactgtctctaacaaaatgaacagcctgagacccgaggacacggctgtttatactgtgcgagagtaaactttagtatttttggagttggttattataccgtcccgggatcttgactacgtgggggccgagggtaccctggccaccgtcctccgtacacgtcctacccaaccgaacggcccctacgtcccggtcccttcccccgtggcccncccctgccctccgaggctccgacccgttcggcggggacccccacggacggcccggtcccgtgggccttacgccggttacggaaccgaaacgggtaccttaacccgttccgggnggttcgtccgttagtcggcgggacgggtccgggtcgtacggggaacacgggccanaagtgnnngnnnnnnnnnnnnnnnnnnnnnnnnnnnn

SEQ ID NO: 343917 - DNA, 530 bp, Homo sapiens
  misc_feature: GZ8MTXP01EK22U.3.41.D08.1.454.CMB.2.raw
  modified_base (376)..(376): a, c, t, g, unknown or other
  misc_feature (376)..(376): n is a, c, g, or t
  modified_base (519)..(530): a, c, t, g, unknown or other
  misc_feature (519)..(530): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggtcttgttttattactgtgacgaagaagtaaactttacgttagtttttggagttaggttattactaccgtccccgggtattcgttgactacggtcggggccgacggggaccctggtccaccgtcctcctcacgtccttacccaccgacggcccctagtcccgttcccttcccccgnggccctcccgtgccctcgacggctccaccgtcggtcggggccacggacggcccggtcccgtgggcctcgtccgtggtaccgtaacggtccttacgtcggagtcgtcgtcgtgcggacggcggcgtacggacgaggcacagagnnnnnnnnnnnn

SEQ ID NO: 343918 - DNA, 541 bp, Homo sapiens
  misc_feature: GZ8MTXP01BOA6E.3.41.D08.1.454.CMB.2.raw
  modified_base (369)..(369): a, c, t, g, unknown or other
  misc_feature (369)..(369): n is a, c, g, or t
  modified_base (523)..(525): a, c, t, g, unknown or other
  misc_feature (523)..(525): n is a, c, g, or t
  modified_base (527)..(541): a, c, t, g, unknown or other
  misc_feature (527)..(541): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattccaccgtctccagagacaacgcccagaactcactgtctctacaaatgaacagcctgacgacccgaggacacggcttgtttattactgtgacgagagtaaacttacgtatttttggagttggttattataccgtcccggattctgtactacgtgggccaggggaccctggtccaccgtctcctcacgtccttaccccaccgaacggcccctacgttcccggttcccttccccccgtggcccncccgtcgccctccgaggactcccaccgtcgggtcggggccccacggcggcccggcccgtgggcctcgcccgttgggtaccaacggtacctttcgtcggaggtcgtccgttgtccgttaggcgggcggtcgtcggggacgaacggccgatagagnnngnnnnnnnnnnnnnnn

SEQ ID NO: 343919 - DNA, 518 bp, Homo sapiens
  misc_feature: GZ8MTXP01AWAJB.3.41.D08.1.454.CMB.2.raw
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (493)..(494): a, c, t, g, unknown or other
  misc_feature (493)..(494): n is a, c, g, or t
  modified_base (496)..(518): a, c, t, g, unknown or other
  misc_feature (496)..(518): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttatactgtgcgagagtaaacttgtattttggagttggttattactaccgtcccgggattcgttagactaggtcggggccgacggggtaccctggccaccgtctccncncgtcctccaccgacggcccagtccgtccttcccccgnggccnccctgccctccgaggacnccacgtcggtcgggccacgcggccgcccgtggcctcgcgtaggtacgaacgtacttaccgtcgagtcctcgttcgtacggcggacgggccggtgtcgggaccgaagggcgaanagngnngnnnnnnnnnnnnnnnnnnnnnnn

SEQ ID NO: 343920 - DNA, 480 bp, Homo sapiens
  misc_feature: GZ8MTXP01B1W06.3.41.D08.1.454.CMB.2.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(456): a, c, t, g, unknown or other
  misc_feature (454)..(456): n is a, c, g, or t
  modified_base (458)..(480): a, c, t, g, unknown or other
  misc_feature (458)..(480): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagaaacttacgtatttttggagttggttattataccgtcccgggtatcttgactacgtggggccaggggaccctggtcacgtctcctcagctccacaacgggcccatcggtctccccngcgccctgctcnggancgcgtcgtcgggggccacgagcgccccgtgggctcgccgtgtacaagggctacttcggagtcgtcgtctcgtggcgtcgggcgtgggacgaaggccgngangnnngnnnnnnnnnnnnnnnnnnnnnnn

SEQ ID NO: 343921 - DNA, 458 bp, Homo sapiens
  misc_feature: GZ8MTXP02FTZF5.3.41.D08.1.454.CMB.2.raw
  modified_base (427)..(427): a, c, t, g, unknown or other
  misc_feature (427)..(427): n is a, c, g, or t
  modified_base (443)..(458): a, c, t, g, unknown or other
  misc_feature (443)..(458): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactacgtggggccaggggaccctggtcaccggtctcctcagcttccaccaagggcccatcggtcttcccctggccgccctggctccaggagccacctcgtggggccacgagcggccctgggctgcctgggtcaaggctacttcgagtgcgtctctgagcgggntggcaaggcgcatagnnnnnnnnnnnnnnnn

SEQ ID NO: 343922 - DNA, 440 bp, Homo sapiens
  misc_feature: GZ8MTXP02F42XA.3.41.D08.1.454.CMB.2.raw
  modified_base (435)..(440): a, c, t, g, unknown or other
  misc_feature (435)..(440): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccacaaggcccatcggtctcccctggcgccctgctccaggagcacctctggggccacagcggccctgggctgcctggtcaaggactacttccgagtgcgtctctgagcgggctggcaaggcgcatagnnnnnn

SEQ ID NO: 343923 - DNA, 441 bp, Homo sapiens
  misc_feature: GZ8MTXP02J0UZ9.3.41.D08.1.454.CMB.2.raw
  modified_base (438)..(441): a, c, t, g, unknown or other
  misc_feature (438)..(441): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgattttggagtggttattatactccccgggatcttgactactggggccaggggaccctggtcaccgtctcctcagcttccaccaagggcccatcggtcttccccctggcgcccctgctccaggagcacctctgggggccacagcggccctgggctgcctggtcaaggctactccgagtgcgtctctgagcgggctggcaaggcgcatagnnnn

SEQ ID NO: 343924 - DNA, 446 bp, Homo sapiens
  misc_feature: GZ8MTXP02GUIN6.3.41.D08.1.454.CMB.2.raw
  modified_base (442)..(446): a, c, t, g, unknown or other
  misc_feature (442)..(446): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggccccatcggtcttccccctggcgccctgctccaggacgcacctctgggggccacagcggccctggggctgcctggtcaaggctacttccgagtgcgtctctgagcgggctggcaaggcgcatagnnnnn

SEQ ID NO: 343925 - DNA, 425 bp, Homo sapiens
  misc_feature: GZ8MTXP02HAJX0.3.41.D08.1.454.CMB.2.raw
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (420)..(425): a, c, t, g, unknown or other
  misc_feature (420)..(425): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccggacggcgtgcncgtctcnatctcacgacgcngtcgtcctccgngccncncncncgngcncnctggcggcacgcgcgcgngcncgcgtcgtagacgtactacgtcgngtcgctctcggagcggggcgtgnggacagggtcntagnnnnnn

SEQ ID NO: 343926 - DNA, 442 bp, Homo sapiens
  misc_feature: GZ8MTXP02FXGLL.3.41.D08.1.454.CMB.2.raw
  modified_base (439)..(442): a, c, t, g, unknown or other
  misc_feature (439)..(442): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccggatcttgactactggggccaggggaccctggtcaccgtctcctcagcttccaccaagggcccatcggtcttcccctggcgccctgctccaggagcacctctgggggccacagcggccctggggctgcctggtcaaaggctacttccgagtgcgtctctgagcgggctggcaaggcgcatagnnnn

SEQ ID NO: 343927 - DNA, 443 bp, Homo sapiens
  misc_feature: GZ8MTXP02JDE1L.3.41.D08.1.454.CMB.2.raw
  modified_base (438)..(443): a, c, t, g, unknown or other
  misc_feature (438)..(443): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaagggcccatcggtctcccctggcgccctgctccaggacgcacctctggggcccacagcgccctgggctgccctggtcaagggactacttccgagtgcgtctctgagcgggctggccaaggcgcatgnnnnnn

SEQ ID NO: 343928 - DNA, 444 bp, Homo sapiens
  misc_feature: GZ8MTXP02GFNJM.3.41.D08.1.454.CMB.2.raw
  modified_base (439)..(444): a, c, t, g, unknown or other
  misc_feature (439)..(444): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggccgccctgctccaggagcacctctgggggccacgagcggccctggctgcctggtcaaggctacttcgagtgcgtctctgagcgggctggcaaggcgcatagnnnnnn

SEQ ID NO: 343929 - DNA, 465 bp, Homo sapiens
  misc_feature: GZ8MTXP02G3L4R.3.41.D08.1.454.CMB.2.raw
  modified_base (454)..(465): a, c, t, g, unknown or other
  misc_feature (454)..(465): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagctccaccaagggccccatccggtcttccccctggccgcccctgcctccaggacgccacctcgtgggggcccacgagccggccctgggctgcctggtcaaggactactccgagtcgcgtctcgtgaggcgggcgtggcaagggcgcatagnnnnnnnnnnnn

SEQ ID NO: 343930 - DNA, 425 bp, Homo sapiens
  misc_feature: GZ8MTXP02HJD9X.3.41.D08.1.454.CMB.2.raw
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
  modified_base (420)..(425): a, c, t, g, unknown or other
  misc_feature (420)..(425): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagctcaccaggcccatcggtctcccctgcncctnctcagncactnggggccncngcgcctggctgcctgtcaggactacttcgagtgcgtcnctgagcgggctggcaaggcgcatagnnnnnn

SEQ ID NO: 343931 - DNA, 443 bp, Homo sapiens
  misc_feature: GZ8MTXP02FR0AG.3.41.D08.1.454.CMB.2.raw
  modified_base (438)..(443): a, c, t, g, unknown or other
  misc_feature (438)..(443): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgcccctgctccaggagcacctctggggccacagcgccctgggctgcctggtcaaggactacttccgagtgcgtctctgagcgggctggcaaggcgcatagnnnnnn

SEQ ID NO: 343932 - DNA, 505 bp, Homo sapiens
  misc_feature: GZ8MTXP02GDTQE.3.41.D08.1.454.CMB.2.raw
  modified_base (496)..(505): a, c, t, g, unknown or other
  misc_feature (496)..(505): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagtggttattatactccccgggatcttgactactggggccagggaccctggtcaccgtctcctcagcttccaccaaggcccatcggtcttccccctggccgccctgcctccaggacgccaccctcgtcgggggcccaccgacggccgggcccccgttggggcccttcggcccgttaggggtccaaaacggggtaccttaccgttcccggagggtccgttccgttccgtggaggcggggctgggcaagggcgacatagnnnnnnnnnn

SEQ ID NO: 343933 - DNA, 430 bp, Homo sapiens
  misc_feature: GZ8MTXP02G38YE.3.41.D08.1.454.CMB.2.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (425)..(430): a, c, t, g, unknown or other
  misc_feature (425)..(430): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagctccaccaaggcccatcgtctcccctgcncctgctcagncactctggggccacngcggcctgggctgcctggtcaaggctacttccgagtgcgtctctgagcgggctggcaaggcgcatagnnnnnn

SEQ ID NO: 343934 - DNA, 487 bp, Homo sapiens
  misc_feature: GZ8MTXP02JB3A3.3.41.D08.1.454.CMB.2.raw
  modified_base (477)..(487): a, c, t, g, unknown or other
  misc_feature (477)..(487): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtccttccccctggccgccctgcctccaggacgccaccgtcgtgggggcccacgacgccgggccccgtggggccttcggcccgtgggtccaaaggggtacctacttcccggagtcgccgtctctggacggcggggctggcgaaggcgcatagnnnnnnnnnnn

SEQ ID NO: 343935 - DNA, 446 bp, Homo sapiens
  misc_feature: GZ8MTXP02IWNX5.3.41.D08.1.454.CMB.2.raw
  modified_base (440)..(446): a, c, t, g, unknown or other
  misc_feature (440)..(446): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagctccaccaaggcccatcggtctcccctggcgccctgctccaggacgcacctcgtggggcccacgagcggccctgggctgcctgggtcaaggactacttccgagtgcgtctctgagcgggctggcaaggcgcatagnnnnnnn

SEQ ID NO: 343936 - DNA, 450 bp, Homo sapiens
  misc_feature: GZ8MTXP02IFH5C.3.41.D08.1.454.CMB.2.raw
  modified_base (373)..(373): a, c, t, g, unknown or other
  misc_feature (373)..(373): n is a, c, g, or t
  modified_base (444)..(450): a, c, t, g, unknown or other
  misc_feature (444)..(450): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggcaggggaccctgggtcaccgtctcctcacgcttccaccagggccccatcggtcttccccctggccgccctgcctccaggacgcacctctgggggccacngcggccctgggctgcctgtcaaggtctacttccgagtcgcgtctctgaggcgggctggcaaggcgcatagnnnnnnn

SEQ ID NO: 343937 - DNA, 451 bp, Homo sapiens
  misc_feature: GZ8MTXP02HGJ5I.3.41.D08.1.454.CMB.2.raw
  modified_base (428)..(428): a, c, t, g, unknown or other
  misc_feature (428)..(428): n is a, c, g, or t
  modified_base (444)..(451): a, c, t, g, unknown or other
  misc_feature (444)..(451): n is a, c, g, or t
tcagagacgcactccacgaccggtgctcgatttagtcacgcgagaaagggaaagggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaaggcccatcggtcttccccctggccgccctgcctccaggacgccacctcgtggggcccacgagccggccctggggctgcctggtcaaggctacgttcgagtgcgtctctgagcgggntggcaaggcgcatagnnnnnnnn

SEQ ID NO: 343938 - DNA, 455 bp, Homo sapiens
  misc_feature: GZ8MTXP02JL8JG.3.41.D08.1.454.CMB.2.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (446)..(455): a, c, t, g, unknown or other
  misc_feature (446)..(455): n is a, c, g, or t
tcagagacgcactccacgaccggtgctcgatttagtcacgcgagaaagggaaggggctggaatgggttgcatacatttcaagtagtggttccaccatacattatgcagactctgtgaagggccgattcaccgtctccagagacaacgcccagaactcactgtctccacaaatgaacagcctgagacccgaggacacggctgtttattactgtgcgagaagaaacttacgtattttggagtggttattatacctcccgggatctgactactgggccagggaccctggtcaccgtctcctcngctcaccacggccatcggtctcccctcggcgccctnctccnggacgcactccgtggggcccgacacggcgcccgtggcgtgcccgtggtcgaaggacctacttccgagtgccgtctctaggngccgggntagcgaaggccgnatgnnnnnnnnnn

SEQ ID NO: 343939 - DNA, 522 bp, Homo sapiens
  misc_feature: GZ8MTXP02IVY7C.3.41.D08.1.454.CMB.2.raw
  modified_base (496)..(522): a, c, t, g, unknown or other
  misc_feature (496)..(522): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatacctccccgggatcttgactacgtgggccaggggaccctggtcaccgtctcctcagcttccaccaagggcccatcggtccttcccccgtggccgcccctgcctccgaggacgccaccgtcgtcgggggcccacgacgcgacccccgtggggccttcggcccgttgggtccaagggtaccttaccgttcccggaggttcgccgttctcgtgacgggccggggctgggaccgaagggccgacgagtagnnnnnnnnnnnnnnnnnnnnnnnnnnn

SEQ ID NO: 343940 - DNA, 484 bp, Homo sapiens
  misc_feature: GZ8MTXP02I8L54.3.41.D08.1.454.CMB.2.raw
  modified_base (467)..(484): a, c, t, g, unknown or other
  misc_feature (467)..(484): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagttggttattataccgtcccggatcttgactacgtggggccaggggaccctggtcaccgtctcctcagcttccaccaacggcccatcggtccttcccctggccgtcccctgcctccaggacgccacctcgtggggcccacgagccggcccgtgggcctgcccgtggtcaaggacctacttccgagtcgcgttctctggagcggggcctggcgaagggcgacagtgcgnnnnnnnnnnnnnnnnnn

SEQ ID NO: 343941 - DNA, 483 bp, Homo sapiens
  misc_feature: GZ8MTXP02GGTMM.3.41.D08.1.454.CMB.2.raw
  modified_base (472)..(483): a, c, t, g, unknown or other
  misc_feature (472)..(483): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagttggttattatactcccgggatcttgactacgtgggccagggaccctggtcaccgtctcctcacgcttccaaccgaacggcccatccggtccttccccctggccgcccctgcctccaggacgcacctcgtggggccacgagcgacccgtgggcctgccgtggtacgaaaggtacctacttccgagttcgcgtctcgtgacggcggggctgggcgaaacgggcgacgtatagnnnnnnnnnnnn

SEQ ID NO: 343942 - DNA, 468 bp, Homo sapiens
  misc_feature: GZ8MTXP02HZALO.3.41.D08.1.454.CMB.2.raw
  modified_base (447)..(447): a, c, t, g, unknown or other
  misc_feature (447)..(447): n is a, c, g, or t
  modified_base (452)..(468): a, c, t, g, unknown or other
  misc_feature (452)..(468): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggcttgtttattactgtgcgagaagaaacttacgtatttttggagttggttattatactcccggatctgactacgtgggccagggccctggtcaccgtctcctcagcttccaccaaggcccagtccgtctccccctgccgccctgctccagagccacctcgtggggccacagccggccctgggcctgcccgtgggtcaaacggctaaccgttccgagttgcgtctctgagcgggcgtggccgaaggcganagagnnnnnnnnnnnnnnnnn

SEQ ID NO: 343943 - DNA, 431 bp, Homo sapiens
  misc_feature: GZ8MTXP02GK5AD.3.41.D08.1.454.CMB.2.raw
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (419)..(419): a, c, t, g, unknown or other
  misc_feature (419)..(419): n is a, c, g, or t
  modified_base (424)..(431): a, c, t, g, unknown or other
  misc_feature (424)..(431): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgattttggagtggttattatactcccgggatcttgactacgtggggccaggggaccctggtcaccgtctcctcagctccaccaggcccatcgtctccctgcncctnctcagncactcgtggggccacagcggccctgggctgcctggtcaaggcctacgtcgagtgcgtctctgagcgggctggcaaggcncatgnnnnnnnn

SEQ ID NO: 343944 - DNA, 464 bp, Homo sapiens
  misc_feature: GZ8MTXP02GQLVO.3.41.D08.1.454.CMB.2.raw
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (455)..(464): a, c, t, g, unknown or other
  misc_feature (455)..(464): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccgaggggaccctggtcaccgtctcctcagcttccaccaggcccatcggtcctccccgtggcgcctgcctccgaggacgcaccgtcgtggggccacgagccggcccgtgggcctgccgtggtacaaggacctacgttccgagtcgcgtctactggagcgggntggccaagggccnatagnnnnnnnnnn

SEQ ID NO: 343945 - DNA, 491 bp, Homo sapiens
  misc_feature: GZ8MTXP02FQI29.3.41.D08.1.454.CMB.2.raw
  modified_base (266)..(266): a, c, t, g, unknown or other
  misc_feature (266)..(266): n is a, c, g, or t
  modified_base (468)..(468): a, c, t, g, unknown or other
  misc_feature (468)..(468): n is a, c, g, or t
  modified_base (485)..(491): a, c, t, g, unknown or other
  misc_feature (485)..(491): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgtatttttggagttggttattataccgtccccggggtnttgtactacgtggggccgacggggacccgtcggttcaccgtccgtcctcagcttcctaccaaaggcccgactcggtccttcccccttcggcgccctcgctcccacggagccacctcgtgggggcaccacgcggccctcggggctcgccgtcgggtcaagggaaccgttacttcccggagtcgcgttcctctggacggcgggntggcgaaggcgcatagnnnnnnn

SEQ ID NO: 343946 - DNA, 570 bp, Homo sapiens
  misc_feature: GZ8MTXP02GQQ3K.3.41.D08.1.454.CMB.2.raw
  modified_base (543)..(570): a, c, t, g, unknown or other
  misc_feature (543)..(570): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgtagagaaacttacgtatttttggagttggttattataccgtccccggatcttgactacgtggggccaggggaccctggtccaccgtctcctcacgtccttccaccgaacgggccccagtccggtcccttcccccgtggcccgcccgtcgcctaccgacgggacgtccacccgtcggtcgggggccccacgacggccggtccccgtgggccgttcgccgtgggtaaccgaaacggtaccgttaacctttccgggagttccggccgttcgtacgtcgggacgggtcccggggcgtacggggacccgaaagggcccgtaacgtaacgagnnnnnnnnnnnnnnnnnnnnnnnnnnnn

SEQ ID NO: 343947 - DNA, 510 bp, Homo sapiens
  misc_feature: GZ8MTXP02GBE4N.3.41.D08.1.454.CMB.2.raw
  modified_base (368)..(368): a, c, t, g, unknown or other
  misc_feature (368)..(368): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (493)..(510): a, c, t, g, unknown or other
  misc_feature (493)..(510): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatacgtccccgggatcttgactacgtggggccaggggaccctggtcaccgtctcctcagccttccaccacgggcccagtccggtccttcccccgtggccgtccccgtgccctccgaggacnccacctcgtggggcccacgacggccggcccgtggggccttcggcccgtgggtacgaaaggtacctaccgttccgagtcggccgttctccgtggacggcgggcgtcgggacgaaggccganagngnnnnnnnnnnnnnnnnnn

SEQ ID NO: 343948 - DNA, 505 bp, Homo sapiens
  misc_feature: GZ8MTXP02GP26F.3.41.D08.1.454.CMB.2.raw
  modified_base (367)..(367): a, c, t, g, unknown or other
  misc_feature (367)..(367): n is a, c, g, or t
  modified_base (489)..(505): a, c, t, g, unknown or other
  misc_feature (489)..(505): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagaaacttacgatttttggagttggttattatacctccccgggatcttgactacgtggggccacggggaccctggtcaccgtctccctcagccttccaccagggccccagtccggtccttccccctggcccgcccctgcctccgaggacnccaccgtcggtgggggaccccacgacgccggccccgtggggcctcggcccgttgggtacaacgggtacctaccgttccggagtcgccgtctcgtgacggcgggctggaccgaggcgcagagnnnnnnnnnnnnnnnnn

SEQ ID NO: 343949 - DNA, 501 bp, Homo sapiens
  misc_feature: GZ8MTXP02ILVIH.3.41.D08.1.454.CMB.2.raw
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (469)..(501): a, c, t, g, unknown or other
  misc_feature (469)..(501): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgacgacccgaggacacggctgtttatactgtgcgagagtaaacttacgtatttttggagttggttattatacctccccgggatcttgactagtgggccaggggccctggtcaccgtcncctcagctccaccgaagggccccattccggtccttcccccnggccnccctgcctccgaggcnccacctggtcggggccacgcgccggccctgggcctgccgttggacaacggtcctacgttcgagtcgacgttcncgtgacgcgggtctgggcgtaaggcnctanaggnnnnnnnnnnnnnnnnnnnnnnnnnnnnnnnnn

SEQ ID NO: 343950 - DNA, 512 bp, Homo sapiens
  misc_feature: GZ8MTXP02H6WDN.3.41.D08.1.454.CMB.2.raw
  modified_base (488)..(512): a, c, t, g, unknown or other
  misc_feature (488)..(512): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggcttgtttattactgtgcgagagtaaacttacgtatttttggagttggttattatactccccgggatcttgactacgtggggccaggggaccctggtccaccgtctcctcacgtccttccaccgaacggccccatccggtccttcccccgtggccgccctgccctccgaggcgccaccgtcggtcggggcccacgcggccggcccgtgggcctcgccgtggtacaacgggtactaccgttcgagtcgcgtctcgtgaggcgggcgtgggaccgaagggccgcagtagcgnnnnnnnnnnnnnnnnnnnnnnnnn

SEQ ID NO: 343951 - DNA, 482 bp, Homo sapiens
  misc_feature: GZ8MTXP02F9QQM.3.41.D08.1.454.CMB.2.raw
  modified_base (354)..(354): a, c, t, g, unknown or other
  misc_feature (354)..(354): n is a, c, g, or t
  modified_base (473)..(482): a, c, t, g, unknown or other
  misc_feature (473)..(482): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttagtatttttggagttggttattataccgtcccggatcttgactacgtggggccgaggggaccctggtcaccgtctcctcagctccaccaggcccatccgtcctcccctggccgccctgcctccaggcnccacctcgtggggccacgcgccggcccgtggggccttcgccgtgggtaccaaaggtaccttaccgttaccggagttcgccgtctcgtggacggcggggtcgtgggcaagggcgcaatgnnnnnnnnnn

SEQ ID NO: 343952 - DNA, 443 bp, Homo sapiens
  misc_feature: GZ8MTXP02JPSSX.3.41.D08.1.454.CMB.2.raw
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (438)..(443): a, c, t, g, unknown or other
  misc_feature (438)..(443): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaaccagcctgagacccgaggacacggctgtttatactgtgcgagttagaaacttacgatttttggagtggttattatactcccgggatcttgactactggggccaggggaccctggtcaccgtctcctcagcttccaccaagggcccatcggtcttcccctgcncctgctccagancaccncgtggggcccacagcgccctgggctgcctggtcaggctacttccgagtgcgtctctgacggcgggctggcaaggcgcgatagnnnnnn

SEQ ID NO: 343953 - DNA, 529 bp, Homo sapiens
  misc_feature: GZ8MTXP02JVHT6.3.41.D08.1.454.CMB.2.raw
  modified_base (304)..(304): a, c, t, g, unknown or other
  misc_feature (304)..(304): n is a, c, g, or t
  modified_base (506)..(529): a, c, t, g, unknown or other
  misc_feature (506)..(529): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagaaacttacgtatttttggagttggttattataccgtcccgggatcttgactacgtggggccaggggaccctggtcaccgtctccncacgccttccaccgaacgggccccagtccggtccctcccccgtggccgccctgcctccgaggcgcctaccgtcggtcgggggcccacgacggcccgggcccgtggggcctcggccgtgggtacgaaacgggtacctccgttcccggagtcgccgttctccgtggacggcggggcgtcgggacgaacgggccgacgagtacgnnnnnnnnnnnnnnnnnnnnnnnn

SEQ ID NO: 343954 - DNA, 545 bp, Homo sapiens
  misc_feature: GZ8MTXP02JG2GW.3.41.D08.1.454.CMB.2.raw
  modified_base (528)..(545): a, c, t, g, unknown or other
  misc_feature (528)..(545): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttattactgtgcgagagtaaacttacgtatttttggagtggttattataccgtccccggatcttgactacgtggggccaggggaccctggtccaccgtctcctcagtccttccacccgaacgggccccagttccggtccctttccccccgtggcccgtccccgtcgtccctcccgacgggtacgcctacccgtcggtgggggccccaccgtacggccggtccccgtggggccttcggcccgtggtaccaagggtaccttacgttcccgagtgccgtcgtccgtggacggtcgggacgtggacccgaagggccgacgagtagnnnnnnnnnnnnnnnnnn

SEQ ID NO: 343955 - DNA, 522 bp, Homo sapiens
  misc_feature: GZ8MTXP02I0HYO.3.41.D08.1.454.CMB.2.raw
  modified_base (505)..(522): a, c, t, g, unknown or other
  misc_feature (505)..(522): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttattactgtgcgagaagtaaacttacgtatttttggagttggtttattataccgtcccgggtattcttgactacggtgggccgacggggaccctggtccaccgtctcctcacgccttccaaccgacgggcccctacgttccggtccccttcccccgtcggcccgtccctgccctcgacggtcgcctacccgtcggtcggggccccacgcggccggcccgtgggctcgccgtggtacaagtacctaccgtcgagtcgtcgtctcgtagcggtcgggcgtaggacgaacggcgacagagnnnnnnnnnnnnnnnnnn

SEQ ID NO: 343956 - DNA, 514 bp, Homo sapiens
  misc_feature: GZ8MTXP02I8OOY.3.41.D08.1.454.CMB.2.raw
  modified_base (260)..(260): a, c, t, g, unknown or other
  misc_feature (260)..(260): n is a, c, g, or t
  modified_base (478)..(478): a, c, t, g, unknown or other
  misc_feature (478)..(478): n is a, c, g, or t
  modified_base (496)..(496): a, c, t, g, unknown or other
  misc_feature (496)..(496): n is a, c, g, or t
  modified_base (500)..(514): a, c, t, g, unknown or other
  misc_feature (500)..(514): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttatactgtgcgagagtaacttacgtatttttggagtggttattataccgtcccggntcttgactacgtcggggccgaggggaccctggtcaccgtcctcctcacgtccttccaccgaacggcccctacgtccggttcccttcccccgtggcccgtcccctgtcccgtccgacggacgccaccgtcggtcggggccccacgacgccgcccgtgggccttcgccgtgtcgaaacggtcctacgttccgagtcggtacctcgtcgtggacggcgggngtcggacgaaggccgtanatgnnnnnnnnnnnnnnn

SEQ ID NO: 343957 - DNA, 472 bp, Homo sapiens
  misc_feature: GZ8MTXP02JYYFH.3.41.D08.1.454.CMB.2.raw
  modified_base (351)..(351): a, c, t, g, unknown or other
  misc_feature (351)..(351): n is a, c, g, or t
  modified_base (458)..(458): a, c, t, g, unknown or other
  misc_feature (458)..(458): n is a, c, g, or t
  modified_base (463)..(472): a, c, t, g, unknown or other
  misc_feature (463)..(472): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaacgaacagcctgagacccgaggacacggctgtttattactgtgcgagagaaacttagtatttttggagttggttattataccgtcccgggatcttgactacgtggggccaggggaccctggtcaccgtctcctcagcttccacaacggccagtcgtctcccctggcgcctgctcaggancaccgtcgtcggggcacccgagccggccctgggctcgtccgtgggtaccaaagggtacctacgttccggagttcgcttctcgtggaggcggggctgggcagggcctnaatgnnnnnnnnnn

SEQ ID NO: 343958 - DNA, 473 bp, Homo sapiens
  misc_feature: GZ8MTXP02HGQGB.3.41.D08.1.454.CMB.2.raw
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (462)..(473): a, c, t, g, unknown or other
  misc_feature (462)..(473): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagaagtaaacttacgtatttttggagttggtacttattactacccggtcccggtattcgtgactcggcgggccggacgggacctcggtccnccgtctccncncgtcctaccaccggacgcctacgtcccgtccctcccgngcctccncgccncgagcncctcgtggccgggcacgcggccgccgtggctcgcgtgacacgtcctacgtcgngtcgtctctagnggcggcgtcgnggcgagcacagnnnnnnnnnnnn

SEQ ID NO: 343959 - DNA, 584 bp, Homo sapiens
  misc_feature: GZ8MTXP02FZPES.3.41.D08.1.454.CMB.2.raw
  modified_base (218)..(218): a, c, t, g, unknown or other
  misc_feature (218)..(218): n is a, c, g, or t
  modified_base (560)..(584): a, c, t, g, unknown or other
  misc_feature (560)..(584): n is a, c, g, or t
tcagagacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctaacaaatgaacagcctgacgacccgaggacacggcttgtttattactgtgngagagtaaacttagtatttttggagttgttatataccgtcccgggattcttgactacggtgggccgacggggaccctggtccaccgtctcctcacgtccttaccaccgacgggtccccagttcccggtcccttcccccgtggccccgtcccctgcccgtccggagggtccgacccgtaccgtccggtcgggggaccccaaccgacgggcccccggggtcccgtcgggggtacctcgggtcccgttaggggaaccgtaaacggggtacccttacgttcccggtaggtcgccgtttcctagtgggacggtcggggtcctaggggaccgaacggcggtacatagnnnnnnnnnnnnnnnnnnnnnnnnn

SEQ ID NO: 343960 - DNA, 526 bp, Homo sapiens
  misc_feature: GZ8MTXP01BR23O.10.7.A07.1.454.CMB.2.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccacctctcctgcagggccagtcagagtattagganctcttagcctggtaccaacagaaatatggccaggctcccaggctcctcatctatgaaacatccaatagggccactgccatccctgccaggttcagtgcagtgggtctgggacagacttcnctctcatcatcagcgctagngctgagnttctgtctagttactactgtcagcgacgtacgagtcggccctccccaaccctcgttccggcggacgggaccaagggtggaagaagttacgaaacgttaacgtggtcggcgttcgcaacccatcctgtccttctaacttcctccccg

SEQ ID NO: 343961 - DNA, 547 bp, Homo sapiens
  misc_feature: GZ8MTXP01ANKN1.10.7.A07.1.454.CMB.2.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (341)..(341): a, c, t, g, unknown or other
  misc_feature (341)..(341): n is a, c, g, or t
  modified_base (519)..(519): a, c, t, g, unknown or other
  misc_feature (519)..(519): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtattagganctcttagcctggtaccaacagaaatntggcaggcnccaggctctnatctatgaaacatccaatacgggccactgccatccctgccaggttcagtggcaggtgggtntggggacagtaacttcaactctcatcatcagcggcctagacgcctagaagtatttactgactagtttactactgtcacgcgtaccgtacgagtcggaccctcccgaacctcgtttaccggcggtacgggaccaagggtggaagtaagttaccgaaacgaacgtggtacggcttcgacnccatctgtcttctaacttccttaacccg

SEQ ID NO: 343962 - DNA, 643 bp, Homo sapiens
  misc_feature: GZ8MTXP01EYVAW.10.7.A07.1.454.CMB.2.raw
  modified_base (195)..(195): a, c, t, g, unknown or other
  misc_feature (195)..(195): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccacctgtctttgtctccgaggggaangccacctctcctgcagggccagtcagagtattaggagtctccttagccttaggtaaccaacaagaaatagtcggccaggcctcccgaggcctcctcattctatacgaaaactatacccaaagtacggggcccactcgcctactcccctagccgtaggttcaggttcggcgaggttggggtcgtgggacacggtaccttcgaactctcatcaatcgacggcggaccttagacgcctaggaagtactttctacgtacgttacgtttactactgtacacgccgtaaccggtacgtacgtccggacccctacccccgaaccgtaccggttaccgggacgggtaacgggaaccggtaagggtcgggtaaacgtaacttaaccggaaaacgttaacgtcgggtacgacgttcgaccgaacctagtcttgtccttcgaactttcccgtaaccccg

SEQ ID NO: 343963 - DNA, 603 bp, Homo sapiens
  misc_feature: GZ8MTXP01D8P6U.10.7.A07.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagcgccaccctctcctgcagggccagtcagagtattagganctcttagcctggtaccaanagaaatntggcaggcnccaggctcctnatctatagaaacataccaataggcccaactaccatccctgcctaggttcagtggcaggtcgggtctggggacagtacttccacttctcatcatcgagcggacctagagcctagaagtattctgtacttaagtttacctattcgtacacgccgtaaccgggtacgaaggttccggacccctacccccgaacccgtacgtttcgggaccgggtaacgggaaccgtaacgggtggaacgaactaacgaaaacgtaaacgttcggtaggtcgttcggaccacccgtaattctcgttcccttacttacttcccttccccgtaaccc

SEQ ID NO: 343964 - DNA, 521 bp, Homo sapiens
  misc_feature: GZ8MTXP02GT2KQ.10.7.A07.1.454.CMB.2.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtattaggagctccttagcctggtaccaacagaaatatggccaggctcccaggctcctcatctatgaaacatccaataggccactgccatccctgccaggttcagtggcagtgggtctggggacagacttcnctctcatcatcagcggcctagagcctgaagattctgctagtttactactgtacagcaccgtaccgagtcggccctccccaaccctactttcggcggagggacccgaaggtggaagagtacaaacgaaactgtcggactgcaaccatctgtcttcactcttcccg

SEQ ID NO: 343965 - DNA, 523 bp, Homo sapiens
  misc_feature: GZ8MTXP02J15S1.10.7.A07.1.454.CMB.2.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagcccaccctgtctttgtctccaggggaaangccaccctctcctgcagggccagtcagagtattagganctccttagcctggtaccaanagaaatntggccaggctcccaggctcctcatctatgaaacatccaatagggccactgccatccctgccaggttcagtgcngtggtctggggacngacttcnctctcatcatcagcgcctagagcctgaagattctgactagtttactactgtcagcaccgtacgagtcggccctaccccaacccctacgtttccgggacggtacgggaccgaaggggtgacgactacgaaacgactgtcgctgacaacgatctcgtctcactctcccg

SEQ ID NO: 343966 - DNA, 556 bp, Homo sapiens
  misc_feature: GZ8MTXP02H2X00.10.7.A07.1.454.CMB.2.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagatattagganctcttagcctggtaccaanagaatnggcaggctccaggctcnatctatgaaacatccaatacggccactgccatcccngcctaggttcaggtggcaggtcgggtctggggacagtacttcnctctnatcatcagcgctagcgctgaagatttcngtctagtttactactgtacagtaccaccggtacgacgtccggacccctacccccgaaaccgtcgtttcgggacgggaacgggtaaccgaaggggtaggaacgactaacgaaaccgaagtcggtcgactcggaccaacctagtcttcgtacttacgtacttccgtccccg

SEQ ID NO: 343967 - DNA, 623 bp, Homo sapiens
  misc_feature: GZ8MTXP02HO9QI.10.7.A07.1.454.CMB.2.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagcatagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtattaggagctcttagcctggtaccaanagaaatnggccaggctccaggctcnatctatgaacntccaagtcggccactgccactccctgcctaggttcagtggcaggtgggtctggggactagtaccttnaccttnactatccaatcgaagtccggacctagacgcctagaaatctttgcggtcttaacggttttacctacgttgttaccgacgtaccgtaacccgggttaccgtacggttcccgggtaccccctacccccgaaacccgttacggtttccggggaccgggaacgggtaacccgaaagggttacggacgtaactacgaaaacgtactcggttaggctacggacctaaccgtagtccgttcgtcctttaccgactttacccctccccg

SEQ ID NO: 343968 - DNA, 439 bp, Homo sapiens
  misc_feature: GZ8MTXP01BDFEP.21.60.F05.1.454.CMB.2.raw
  modified_base (433)..(439): a, c, t, g, unknown or other
  misc_feature (433)..(439): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggcccggggaaccctggtcaccgtctcctcggcctccaccaagggcccatcggtcttccccctggccgcccctgctccaggagcaccctccgagagcacagcggccccctggggctgcctggtcaaggctactcccgagcgacgactgagcgggctggcaaggcgcatagnnnnnnn

SEQ ID NO: 343969 - DNA, 433 bp, Homo sapiens
  misc_feature: GZ8MTXP01AQ1JJ.21.60.F05.1.454.CMB.2.raw
  modified_base (194)..(194): a, c, t, g, unknown or other
  misc_feature (194)..(194): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (427)..(433): a, c, t, g, unknown or other
  misc_feature (427)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgacccctggggccggggaaccctggtcaccgtctcctcggcctccaccaagggcccatcggtcttccccctggcgcccctgctccaggagcacctccgagagcacagcggccccctggggctgcctggtcaaggctactcccgagcgacgactgagcgggcnggcaggcncanannnnnnn

SEQ ID NO: 343970 - DNA, 435 bp, Homo sapiens
  misc_feature: GZ8MTXP01B1C9C.21.60.F05.1.454.CMB.2.raw
  modified_base (427)..(427): a, c, t, g, unknown or other
  misc_feature (427)..(427): n is a, c, g, or t
  modified_base (429)..(435): a, c, t, g, unknown or other
  misc_feature (429)..(435): n is a, c, g, or t
tcagtcgtcgctcgcacgaccggtgctcgatttagtacgtcatcagggaaagggctggagtgggtgcgtatggaagcaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttgaagttcgacccctgggggcccgggaaccctggtcacgtctcctcggcctccaccaagggcccatcggtcttccccctggcgcccctgctcccaggagcacctccgagagcacagcggccccctgggctgccctggtcaaggctacgttcccgagccgacgacgtgacgcgggctgggcaagggcanannnnnnn

SEQ ID NO: 343971 - DNA, 434 bp, Homo sapiens
  misc_feature: GZ8MTXP01CCLVI.21.60.F05.1.454.CMB.2.raw
  modified_base (430)..(434): a, c, t, g, unknown or other
  misc_feature (430)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgaccccgtgggggcccgggaaccctggtcaccgtctcctcggcctccaccaagggcccatcggtcttccccctggcgccctgctccaggagcacctccgagagcacagcggcccccctgggctgcctggtcaaggctacttcccgagcgacgactgagcgggctggcaaggcgcatagnnnnn

SEQ ID NO: 343972 - DNA, 439 bp, Homo sapiens
  misc_feature: GZ8MTXP01AVXAI.21.60.F05.1.454.CMB.2.raw
  modified_base (290)..(290): a, c, t, g, unknown or other
  misc_feature (290)..(290): n is a, c, g, or t
  modified_base (431)..(439): a, c, t, g, unknown or other
  misc_feature (431)..(439): n is a, c, g, or t
tcagtcgtcgctcgcacgaccggtgctcgatttagtacgtcatcagggaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggcccggggaaccctggtcaccgtctccncggcctccaccaagggcccatcggtcttccccctggccgccctgctccaggagcacctccgagagcacagcggccccctggggctgccctggtcaaggctactcccgagcgacgactgagcgggctggcaaggcgcatagnnnnnnnnn

SEQ ID NO: 343973 - DNA, 433 bp, Homo sapiens
  misc_feature: GZ8MTXP01DT2KK.21.60.F05.1.454.CMB.2.raw
  modified_base (192)..(192): a, c, t, g, unknown or other
  misc_feature (192)..(192): n is a, c, g, or t
  modified_base (286)..(286): a, c, t, g, unknown or other
  misc_feature (286)..(286): n is a, c, g, or t
  modified_base (424)..(424): a, c, t, g, unknown or other
  misc_feature (424)..(424): n is a, c, g, or t
  modified_base (430)..(433): a, c, t, g, unknown or other
  misc_feature (430)..(433): n is a, c, g, or t
tcagtcgtcgctcgcacgaccggtgctcgattagtacgtcatcagggaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgatggttgaagttcgacccctgggggccgggaaccctggtcaccgtctccncggcctccaccaaggcccatcggtctccccctggccgcccctgcctccaggagcacctccgagagcacagcggccccctgggctgccctggtacaagggctactcccgagcgacgactgagcgggctgggcaagggcncatagnnnn

SEQ ID NO: 343974 - DNA, 437 bp, Homo sapiens
  misc_feature: GZ8MTXP01CJZOV.21.60.F05.1.454.CMB.2.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (431)..(437): a, c, t, g, unknown or other
  misc_feature (431)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtctattactgtgctagacctagtggctcgtccgatggttgaagttcgaccccgtgggggcccggggaaccctggtcaccgtctcctcggcctccaccaagggcccatcggtcttccccctggcgcccctgctccaggngcacctccgagagcacngcggcccccctgggctgcctggtcaagggcacttcccgagcgacgactgagcgggctggcaaggcgcatagnnnnnnn

SEQ ID NO: 343975 - DNA, 427 bp, Homo sapiens
  misc_feature: GZ8MTXP01BPQ18.21.60.F05.1.454.CMB.2.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
  modified_base (415)..(427): a, c, t, g, unknown or other
  misc_feature (415)..(427): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtcgatggtgaagttcgacccgtggggccgggacctggtcaccgtctccncggcctccacaggcccatcgtctccccngcncctgctccaggcncaccncgagngcacngccgccccctgggctgcctggacaaggctactcccgagccgacgactgagcgggctgggcaagggcncatgnnnnnnnnnnnnn

SEQ ID NO: 343976 - DNA, 439 bp, Homo sapiens
  misc_feature: GZ8MTXP01B2HKL.21.60.F05.1.454.CMB.2.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
  modified_base (427)..(427): a, c, t, g, unknown or other
  misc_feature (427)..(427): n is a, c, g, or t
  modified_base (433)..(439): a, c, t, g, unknown or other
  misc_feature (433)..(439): n is a, c, g, or t
tcagtcgtcgctcgcacgaccggtgctcgattagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggttgaagttcgaccccgtgggggcccggggaaccctggtcaccgtctcctcggcctccaccaagggcccatcggtctccccctggccgcccctgctccaggngcaccctcgagagcacagcggccccctggggctgcctggtcaaggctacttcccgagcgacgactgagcgggctgggcaaggcncatagnnnnnnn

SEQ ID NO: 343977 - DNA, 438 bp, Homo sapiens
  misc_feature: GZ8MTXP01AY7A5.21.60.F05.1.454.CMB.2.raw
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
  modified_base (417)..(417): a, c, t, g, unknown or other
  misc_feature (417)..(417): n is a, c, g, or t
  modified_base (433)..(438): a, c, t, g, unknown or other
  misc_feature (433)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgaccccgtgggggccggggacctggtcaccgtctccncggcctccaccaagggcccatcggtcttccccctggccgccctgctccaggacgcaccctccgagngcacagccggcccccctggggctgcctggtcaaggcctactcccgagcgacgactgagcgggntggcaaggcgcatagnnnnnn

SEQ ID NO: 343978 - DNA, 459 bp, Homo sapiens
  misc_feature: GZ8MTXP01EGMN6.21.60.F05.1.454.CMB.2.raw
  modified_base (444)..(444): a, c, t, g, unknown or other
  misc_feature (444)..(444): n is a, c, g, or t
  modified_base (449)..(459): a, c, t, g, unknown or other
  misc_feature (449)..(459): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaacccgaggacacggccgtctattactgtgctagacctagtggctcgtccgactggttgaagttcgaccccgtgggggcccggggaaccctggtcaccgtctcctcggcctccaccaagggcccatccggtccttccccctggccgcccctgcctccaggagccaccctccgagagccacacggccggcccccctggggctgcctgggtacaaggctacctcccgagcgacgactgagcgggctgggcaaggcgnatagnnnnnnnnnnn

SEQ ID NO: 343979 - DNA, 442 bp, Homo sapiens
  misc_feature: GZ8MTXP01BHDGE.21.60.F05.1.454.CMB.2.raw
  modified_base (194)..(194): a, c, t, g, unknown or other
  misc_feature (194)..(194): n is a, c, g, or t
  modified_base (431)..(442): a, c, t, g, unknown or other
  misc_feature (431)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccccgtggggcccggggaaccctggtcaccgtctcctcggcctccaccaagggcccatccggtcttccccctggcgcccctgctccaggacgcacctccgagagcacagcggccccctgggctgcctggtcaaggctactcccgagcgacgactgagcgggctggcaggcgcatagnnnnnnnnnnnn

SEQ ID NO: 343980 - DNA, 432 bp, Homo sapiens
  misc_feature: GZ8MTXP01EGSHK.21.60.F05.1.454.CMB.2.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (350)..(350): a, c, t, g, unknown or other
  misc_feature (350)..(350): n is a, c, g, or t
  modified_base (409)..(409): a, c, t, g, unknown or other
  misc_feature (409)..(409): n is a, c, g, or t
  modified_base (425)..(432): a, c, t, g, unknown or other
  misc_feature (425)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattacngtgctagacctagtggctcgtccgatggttnaagttcgaccccgtgggggcccgggaacctggtcacgtctccncggcctccaccaaggcccatcggtctcccctggcnccctgctccaggcgcaccctcgagancacagccggccccctgggctgcctggtcaaggctactcccgagcgacgactgagcgggntggcaaggcgcatagnnnnnnnn

SEQ ID NO: 343981 - DNA, 451 bp, Homo sapiens
  misc_feature: GZ8MTXP01ETLTM.21.60.F05.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (434)..(451): a, c, t, g, unknown or other
  misc_feature (434)..(451): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagccctagaaaaccgnggacacggccgtctattactgtgctagacctagtggctcgtccgatggttgaagttcgaccccgtgggggcccgggaacctggtcacgtctccncggcctcacaaggcccatccggtcttccccnggccnccctgctccaggcgcaccctcgagagcacgacgcggccccctgggctgcctggtacaaggctacgtcccgagcgacgactgacgcgggctgggcaagggcgcaagtgnnnnnnnnnnnnnnnnnn

SEQ ID NO: 343982 - DNA, 432 bp, Homo sapiens
  misc_feature: GZ8MTXP01DCEII.21.60.F05.1.454.CMB.2.raw
  modified_base (215)..(215): a, c, t, g, unknown or other
  misc_feature (215)..(215): n is a, c, g, or t
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (426)..(432): a, c, t, g, unknown or other
  misc_feature (426)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattacngtgctagacctagtggctcgtccgatggttgaagttcgaccccgtgggggcccgggaacctggtcaccgtctccncggcctccaccaaggcccatcggtctccccngcgcctgctccaggagcacctccgagagcacagcggccccctggggctgccctggtacaaggctacctcccgagcgacgactgagcggctggcaaggcgcatagnnnnnnn

SEQ ID NO: 343983 - DNA, 439 bp, Homo sapiens
  misc_feature: GZ8MTXP01DLSB1.21.60.F05.1.454.CMB.2.raw
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (425)..(439): a, c, t, g, unknown or other
  misc_feature (425)..(439): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtgggggcccggggaaccctggtcaccgtctcctcggcctccacaggcccatcggtctcccctgccncctgctccagngcacccgtcgagncancgccgccccgnggcngctgacaggctcgtcccgagcgacgctggacgcgggctggacgaaggcgactagagnnnnnnnnnnnnnnn

SEQ ID NO: 343984 - DNA, 432 bp, Homo sapiens
  misc_feature: GZ8MTXP01DRTFK.21.60.F05.1.454.CMB.2.raw
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (425)..(432): a, c, t, g, unknown or other
  misc_feature (425)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtctattactgtgctagacctagtggctcgtccgactggttgaagttcgaccccgtgggggcccggggaacctggtcaccgtctcctcggcctccaccaagggcccatcggtctcccctgcgccctgctcagngcacctccgagngcacagcggccccctgggctgcctggtcaagggctacttcccgagcgacgactgagcgggctggcaaggcgcatagnnnnnnnn

SEQ ID NO: 343985 - DNA, 492 bp, Homo sapiens
  misc_feature: GZ8MTXP01AXZN7.21.60.F05.1.454.CMB.2.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (471)..(478): a, c, t, g, unknown or other
  misc_feature (471)..(478): n is a, c, g, or t
  modified_base (480)..(492): a, c, t, g, unknown or other
  misc_feature (480)..(492): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattacngtgctagacctagtggctcgtccgactggttgaacgttccgaccccgtgggggcccgggaacctggtcaccgtctcccgcggcctccgaccaagggcccagtccggtccttcccccgtggccgcccctgcctccgaggacgccaccctccgagacgccacgacgtccggccccctggggctgccctggtacaaggcctacctcccgagccgacgacgtggacgcggggtctgggaccgaagggccgactaagtagnnnnnnnngnnnnnnnnnnnnn

SEQ ID NO: 343986 - DNA, 466 bp, Homo sapiens
  misc_feature: GZ8MTXP01A14PP.21.60.F05.1.454.CMB.2.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (457)..(466): a, c, t, g, unknown or other
  misc_feature (457)..(466): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtgctcgtccgatggttgaagttccgacccgtgggggcccgggaacctggtcaccgtctccgtcggcctccaccaacgggcccatccggtccttcccccgtggcccgcccctgcctccgaggcnccaccctcgagacncacgagccggcccccgtgggctgcccgtggtaccaaggtcctacgtcccgagccgacgactggacgcgggctgggacgaaggcgacagtagnnnnnnnnnn

SEQ ID NO: 343987 - DNA, 468 bp, Homo sapiens
  misc_feature: GZ8MTXP01B0OPG.21.60.F05.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (454)..(468): a, c, t, g, unknown or other
  misc_feature (454)..(468): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttnagttcgacccgtgggggccgggacctggtcaccgtctccncggcctccaccaaggcccatcggtctccccctggcnccctgctccaggacnccaccctccgagacgcacgacgccggcccccgtggggctcggccctggtaccaaagggtcctacttccccgagccgacgctggacggcgggctgggacaagggtccgacaagtggnnnnnnnnnnnnnnn

SEQ ID NO: 343988 - DNA, 433 bp, Homo sapiens
  misc_feature: GZ8MTXP01BWH5L.21.60.F05.1.454.CMB.2.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (420)..(433): a, c, t, g, unknown or other
  misc_feature (420)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtcgatggtgagttcgacccgtggggccgggacctggcncgtcncncgctcacaggccntcgtctcccngcncctgcncagcncaccncgagncacgngccgccccgtgggctcgcctggtaacaaggtctaccgtcccgagccgacgacgtggacggcgggctgggacgaacgggcgacagtagnnnnnnnnnnnnnn

SEQ ID NO: 343989 - DNA, 445 bp, Homo sapiens
  misc_feature: GZ8MTXP01EI0KO.21.60.F05.1.454.CMB.2.raw
  modified_base (291)..(291): a, c, t, g, unknown or other
  misc_feature (291)..(291): n is a, c, g, or t
  modified_base (437)..(445): a, c, t, g, unknown or other
  misc_feature (437)..(445): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgaccccgtgggggcccggggaaccctggtcaccgtctccncggcctccaccgaagggcccatcggtcttccccctggccgccctgctccaggacgcaccctccgagagcacagccggccccctggggctgcctggtacaaggctactcccgagcgacgactgagcgggctggcaaggcgacatagnnnnnnnnn

SEQ ID NO: 343990 - DNA, 563 bp, Homo sapiens
  misc_feature: GZ8MTXP01EEORJ.21.60.F05.1.454.CMB.2.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (526)..(533): a, c, t, g, unknown or other
  misc_feature (526)..(533): n is a, c, g, or t
  modified_base (535)..(563): a, c, t, g, unknown or other
  misc_feature (535)..(563): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaaagaacacggcgtatctgacaaatgagcagcctagaaaaccgnggacacggccgtctattactgtnctagacctagtggcctcgtccgatggttgaacgttccgaccccgtgggggcccggggaccctggtcacccgtctcccgcggccctccaccgaacgggccccagttcccggtcccttccccccgtggcccgtccccttggcctacccgagggtacgccctacccgtccggagacgccaacgacggccggtccccccgttgggggctcggcccgtggtaacccgaacgggtccttaccgttccccggagtacccggacggtactgggacgggccggggctagggaccaaggggccaacgtatacggnnnnnnnngnnnnnnnnnnnnnnnnnnnnnnnnnnnnn

SEQ ID NO: 343991 - DNA, 487 bp, Homo sapiens
  misc_feature: GZ8MTXP01BHUCN.21.60.F05.1.454.CMB.2.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (289)..(289): a, c, t, g, unknown or other
  misc_feature (289)..(289): n is a, c, g, or t
  modified_base (459)..(466): a, c, t, g, unknown or other
  misc_feature (459)..(466): n is a, c, g, or t
  modified_base (468)..(487): a, c, t, g, unknown or other
  misc_feature (468)..(487): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattacngtgctagacctagtggctcgtcgatggttnaagttcgaccccgtgggggcccgggaacctggtcaccgtctccncggcctccaccaagggcccatccggtctccccctggccgccctgctccaggcgcaccctcgagacgcacagccggcccccctggggctgcccgtggtaccaagggcctacttccccggagccgacgaccgtgacggccgggacctgggccaaagggtcgacgtaagtggnnnnnnnngnnnnnnnnnnnnnnnnnnnn

SEQ ID NO: 343992 - DNA, 481 bp, Homo sapiens
  misc_feature: GZ8MTXP01A6U86.21.60.F05.1.454.CMB.2.raw
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
  modified_base (466)..(481): a, c, t, g, unknown or other
  misc_feature (466)..(481): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaaatgagcagcctagaaaaccgaggacacggccgtctattactgtgctagacctagtggctcgtccgatggttgaagttccgacccgtgggggcccgggaacctggtcaccgtctccncggcctccaccgaacggcccatccggtccttcccccgtggcccgccctgctccgaggacnccaccctcgagacgcaacgacgccggtccccgnggggctggcccgtaggaacccaaaggtcctacctcccggagtaccgacgactggacggcggctaggacaaggctcaanagnnnnnnnnnnnnnnnn

SEQ ID NO: 343993 - DNA, 508 bp, Homo sapiens
  misc_feature: GZ8MTXP01BCHRU.21.60.F05.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (486)..(493): a, c, t, g, unknown or other
  misc_feature (486)..(493): n is a, c, g, or t
  modified_base (495)..(508): a, c, t, g, unknown or other
  misc_feature (495)..(508): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggtgaagttcgacccgtgggggcccgggacctggcaccgtctccncgcctccacgacggccatccggtccttccccgnggccgcccctgcctccgaggcnccacccgtcgagacgcacgcggcccggtcccccgtggggctcggcccgtgggtaaccaaacgggtcccttacccgttccccgggaagcccggaacggtacgtgggacgggtcgggggctaggggacaaggggccactaagtacgnnnnnnnngnnnnnnnnnnnnnn

SEQ ID NO: 343994 - DNA, 442 bp, Homo sapiens
  misc_feature: GZ8MTXP01CB76A.21.60.F05.1.454.CMB.2.raw
  modified_base (215)..(215): a, c, t, g, unknown or other
  misc_feature (215)..(215): n is a, c, g, or t
  modified_base (288)..(288): a, c, t, g, unknown or other
  misc_feature (288)..(288): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (419)..(419): a, c, t, g, unknown or other
  misc_feature (419)..(419): n is a, c, g, or t
  modified_base (434)..(442): a, c, t, g, unknown or other
  misc_feature (434)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattacngtgctagacctagtggctcgtccgatggttgaagttcgacccctgggggccgggaacctggtcaccgtctccncggcctccaccaagggcccatcggtctccccnggccnccctgctccaggacncacctcgagacgcacaggtccggcccccctggggctgccctggtacaaggtctacctcccgagcgacactgacgcgggntggcaggcgcatagnnnnnnnnn

SEQ ID NO: 343995 - DNA, 524 bp, Homo sapiens
  misc_feature: GZ8MTXP01EAF6Q.21.60.F05.1.454.CMB.2.raw
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
  modified_base (493)..(499): a, c, t, g, unknown or other
  misc_feature (493)..(499): n is a, c, g, or t
  modified_base (501)..(524): a, c, t, g, unknown or other
  misc_feature (501)..(524): n is a, c, g, or t
tcagtcgtcgctcgcacgaccggtgctcgattagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagactagtgctcgtccgntggtgaagttcgacccgtgggggccgggacctggtcaccgtctccncggccctccaccgagggcccatccggtccttccccctggccgccctgctccaggacnccaccctcgagacgcacgcggccggcccccgnggggctcggccccgtggtaacccaaacggtcccttacccgttccccggacggtacccgaaccggaacgtgggacggaccgggggtctcggggaccgaaaggggccgacgaagtaaggcgnnnnnnngnnnnnnnnnnnnnnnnnnnnnnnn

SEQ ID NO: 343996 - DNA, 440 bp, Homo sapiens
  misc_feature: GZ8MTXP01BRLIY.21.60.F05.1.454.CMB.2.raw
  modified_base (219)..(219): a, c, t, g, unknown or other
  misc_feature (219)..(219): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (420)..(420): a, c, t, g, unknown or other
  misc_feature (420)..(420): n is a, c, g, or t
  modified_base (426)..(440): a, c, t, g, unknown or other
  misc_feature (426)..(440): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaaagaacacggcgtatctgcaaatgagcagcctagaaaaccgaggacacggccgtctattactgtnctagacctagtggctcgtcgattggtgaagttccgacccgtgggggccgggacctggtcaccgtctcgtccggcctccacgaggcccatccggtctccccngcnccctgccncagcncacctcgngagcacngccgccccgtggctgccgtgtacaacgctacgtccgagccgacgacgtgacgcgggtgcgacgaggtcncagtgnnnnnnnnnnnnnnn

SEQ ID NO: 343997 - DNA, 444 bp, Homo sapiens
  misc_feature: GZ8MTXP01C3JEA.21.60.F05.1.454.CMB.2.raw
  modified_base (218)..(218): a, c, t, g, unknown or other
  misc_feature (218)..(218): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (438)..(444): a, c, t, g, unknown or other
  misc_feature (438)..(444): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaaatgagcagcctgaaaaccgaggacacggccgtctattactgtnctagacctagtgctcgtccgatggtgaagttcgacccgtgggggcccgggaaccctggtcaccgtctcctcggcctccaccaagggcccagtccggtcttcccccctggcgcccctgcctcccaaggacgccaccctcccgagagcacagccggccccctggggctgcctggtcaaggctactcccgagcgacgatgagcggcnggcaaggcncaatcgnnnnnnn

SEQ ID NO: 343998 - DNA, 431 bp, Homo sapiens
  misc_feature: GZ8MTXP02IG94J.21.60.F05.1.454.CMB.2.raw
  modified_base (427)..(431): a, c, t, g, unknown or other
  misc_feature (427)..(431): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggcccggggaaccctggtcaccgtctcctcggcctccaccaaggcccatcggtctccccctggcgccctgctccaggagcacctccgagagcacagcggccccctgggctgcctggtcaaggctacttcccgagccgacgctgagcgggctggcaaggcgcatagnnnnn

SEQ ID NO: 343999 - DNA, 439 bp, Homo sapiens
  misc_feature: GZ8MTXP02F4J8M.21.60.F05.1.454.CMB.2.raw
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
  modified_base (433)..(439): a, c, t, g, unknown or other
  misc_feature (433)..(439): n is a, c, g, or t
tcagtcgtcgctcgcacgaccggtgctcgatttagtacgtcatcagggaaagggctggagtgggttggccgtattggaagcaaactaacaattacgcgacaacatatgctgcgtcggtgaaaggcaggttcaccatctccagagatgattcaaagaacacggcgtatctgcaaatgagcagcctagaaaacccgnggacacggccgtctattactgtgctagacctagtggctcgtcgactggtgaagttcgaccccgtggggccggggaaccctggtcaccgtctcctcggcctccaccaagggccccatccggtcttccccctggccgccctgctccaggcgcaccctccgagacgcacaggtcgcccctgggctgcctggcaaggctactcccgagcgacgactgacgcgggctggcaaggcgctanagnnnnnnn

SEQ ID NO: 344000 - DNA, 437 bp, Homo sapiens
  misc_feature: GZ8MTXP02HAQ3W.21.60.F05.1.454.CMB.2.raw
  modified_base (409)..(409): a, c, t, g, unknown or other
  misc_feature (409)..(409): n is a, c, g, or t
  modified_base (433)..(437): a, c, t, g, unknown or other
  misc_feature (433)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtggggcccggggaaccctggtcaccgtctcctcggcctccaccaaggccccatcggtcttccccctggcgcccctgctccaggagcacctccgagagcacaggcggccccctggggctgcctggtcaaggctactcccgagcgacgacngagcgggctggcaaggcgcatagnnnnn

SEQ ID NO: 344001 - DNA, 453 bp, Homo sapiens
  misc_feature: GZ8MTXP02HDTDX.21.60.F05.1.454.CMB.2.raw
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (439)..(453): a, c, t, g, unknown or other
  misc_feature (439)..(453): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgacccctggggcccggggaaccctggtcaccgtcncctcggcctccaccaagggcccatcggtcttccccctggcgccctgctccagganccaccctccgagacgcacagcggcccccctggggcctgcctggtcaagggctacttcccgagcgacgactgacgcgggctggcaagggcgcagtacgnnnnnnnnnnnnnnn

SEQ ID NO: 344002 - DNA, 433 bp, Homo sapiens
  misc_feature: GZ8MTXP02IQ23T.21.60.F05.1.454.CMB.2.raw
  modified_base (430)..(433): a, c, t, g, unknown or other
  misc_feature (430)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtctattactgtgctagacctagtggctcgtccgactggttgaagttcgacccctggggccggggaaccctggtcaccgtctcctcggcctccaccaagggccccatcggtcttccccctggcgccctgctccaggagcacctccgagagcacagcggccccctggggctgcctggtcaagggctacttcccgagcgacgactgagcgggctggcaaggcgcatagnnnn

SEQ ID NO: 344003 - DNA, 436 bp, Homo sapiens
  misc_feature: GZ8MTXP02JZUZZ.21.60.F05.1.454.CMB.2.raw
  modified_base (433)..(436): a, c, t, g, unknown or other
  misc_feature (433)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtctattactgtgctagacctagtggctcgtccgactggttgaagttcgacccctggggcccgggaaccctggtcaccgtctcctcggcctccaccaagggccccatccggtcttccccctggccgcccctgcctccaggagcacctcgagagcacagcggcccccctgggctgcctggcaaggcctactcccgagcgacgactgacgcggggctggcaaggcgcatagnnnn

SEQ ID NO: 344004 - DNA, 438 bp, Homo sapiens
  misc_feature: GZ8MTXP02HSZPD.21.60.F05.1.454.CMB.2.raw
  modified_base (195)..(195): a, c, t, g, unknown or other
  misc_feature (195)..(195): n is a, c, g, or t
  modified_base (245)..(245): a, c, t, g, unknown or other
  misc_feature (245)..(245): n is a, c, g, or t
  modified_base (431)..(438): a, c, t, g, unknown or other
  misc_feature (431)..(438): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggtnaagttcgaccccgtggggcccgggaaccctggtcaccgtctcctcgcctccaccaaggcccatcggtcttccccctggccgccctgctcccaggacgcacctccgagagcacagcggccccctggggctgcctggtcaaggctactcccgagccgacgactgacgcgggctggcaaggcgcatagnnnnnnnn

SEQ ID NO: 344005 - DNA, 437 bp, Homo sapiens
  misc_feature: GZ8MTXP02IB5YT.21.60.F05.1.454.CMB.2.raw
  modified_base (431)..(437): a, c, t, g, unknown or other
  misc_feature (431)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaaggccccatcggtcttccccctggcgccctgctccaggagcaccctccgagagcacagcggccccctggggctgcctggtcaaggctactcccgagcgacgactgagcggggctggcaagggcgcatagnnnnnnn

SEQ ID NO: 344006 - DNA, 429 bp, Homo sapiens
  misc_feature: GZ8MTXP02GR0GG.21.60.F05.1.454.CMB.2.raw
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (423)..(429): a, c, t, g, unknown or other
  misc_feature (423)..(429): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgatggttgaagttcgacccctggggcccggggaaccctggtcaccgtctcctcggcctccacaaggccccatcggtctccccngcgccctgctccaggngcacctcgagagcacagcggccccctgggctgcctggtcaaggctactcccgagcgacgactgagcggggctggcaaggcgcatagnnnnnnn

SEQ ID NO: 344007 - DNA, 434 bp, Homo sapiens
  misc_feature: GZ8MTXP02JXTVX.21.60.F05.1.454.CMB.2.raw
  modified_base (429)..(434): a, c, t, g, unknown or other
  misc_feature (429)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccatagatgattcaaagaacacggcgtatctgcaaatgagcagcctgaaaccgaggacacggccgtctattactgtgctagacctagtggctcgtccgactggttgaagttcgacccctggggcccggggaaccctggtcaccgtctcctcggcctccaccaagggcccatcggtcttcccctggcgccctgctccaggagcaccctccgagagcacagcggccccctggggctgcctggtcaagggcctactcccgagcgacgactgagcgggctggcaaggcgcatgnnnnnn

SEQ ID NO: 344008 - DNA, 434 bp, Homo sapiens
  misc_feature: GZ8MTXP02G20Q9.21.60.F05.1.454.CMB.2.raw
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
  modified_base (431)..(434): a, c, t, g, unknown or other
  misc_feature (431)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaaccctggtcaccgtctcctcggcctccaccaaggccccatccggtcttccccctggccgccctgctccaggacgcaccctccgagngcacaggcgccccctggggctgcctggcaaggctactccgagcgacgactgagcgggctggcaagggcnatgnnnn

SEQ ID NO: 344009 - DNA, 460 bp, Homo sapiens
  misc_feature: GZ8MTXP02JJBBD.21.60.F05.1.454.CMB.2.raw
  modified_base (446)..(460): a, c, t, g, unknown or other
  misc_feature (446)..(460): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaacccgtggtcaccgtctcctcggcctccaccaacggcccactccggtcttcccccccccctggccgccctcgctccaggacgccacctccgagacgcacagcggccccctgggctcgcctggtcaacggctactcccgagccgacgactgacgcgggctggcaaggcgcatagnnnnnnnnnnnnnnn

SEQ ID NO: 344010 - DNA, 440 bp, Homo sapiens
  misc_feature: GZ8MTXP02JGSCY.21.60.F05.1.454.CMB.2.raw
  modified_base (433)..(440): a, c, t, g, unknown or other
  misc_feature (433)..(440): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggccccatcggtcttccccctggcgcccctgctcccaggagcaccctccgagacgcacagcggccccctggggctgcctggtcaaggctactcccgagcgacgactgagcgggctggcaaggcgcatagnnnnnnnn

SEQ ID NO: 344011 - DNA, 441 bp, Homo sapiens
  misc_feature: GZ8MTXP02IK43N.21.60.F05.1.454.CMB.2.raw
  modified_base (433)..(441): a, c, t, g, unknown or other
  misc_feature (433)..(441): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttgaagttcgacccctggggcccggggaaccctggtcaccgtctcctcggcctccaccaagggcccatcggtcttccccctggccgccctgctccaggagcacctccgagagcacagcggccccctgggctgcctggtcaaggctacttcccgagccgacgactgacgcgggctggcaagggcgcatagnnnnnnnnn

SEQ ID NO: 344012 - DNA, 448 bp, Homo sapiens
  misc_feature: GZ8MTXP02IXFOW.21.60.F05.1.454.CMB.2.raw
  modified_base (425)..(425): a, c, t, g, unknown or other
  misc_feature (425)..(425): n is a, c, g, or t
  modified_base (440)..(448): a, c, t, g, unknown or other
  misc_feature (440)..(448): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaaccctggtcaccgtctcctcggcctccaccaagggccccatcggtccttccccctggccgccctgctccaggacgcaccctccgagagccacgagccggccccctggggctgcctggtcaagggctacttcccgagcgacgactgagcgggcnggcaaggcgcatagnnnnnnnnn

SEQ ID NO: 344013 - DNA, 433 bp, Homo sapiens
  misc_feature: GZ8MTXP02IJ6EN.21.60.F05.1.454.CMB.2.raw
  modified_base (430)..(433): a, c, t, g, unknown or other
  misc_feature (430)..(433): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtgctcgtccgactggttgaagttcgacccctggggcccggggaaccctggtcaccgtctcctcggcctccaccaaggcccatcggtctccccctggcgccctgctccaggagccacctccgagagcacagcggccccctggggctgcctggtcaaggctacttcccgagcgacgactgagcgggctggcaagggcgcatagnnnn

SEQ ID NO: 344014 - DNA, 434 bp, Homo sapiens
  misc_feature: GZ8MTXP02H2CKI.21.60.F05.1.454.CMB.2.raw
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (424)..(434): a, c, t, g, unknown or other
  misc_feature (424)..(434): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggcccggggaaccctggtcaccgtctcctcggcctccaccaagggcccatcggtctcccctgcgccctgctccagagcactccgagngcacagcgccccctgggctgcctggtcaaggctacttcccgagcgacgactgagcgggcgnggcgaggcgnagagnnnnnnnnnnn

SEQ ID NO: 344015 - DNA, 439 bp, Homo sapiens
  misc_feature: GZ8MTXP02HEHUM.21.60.F05.1.454.CMB.2.raw
  modified_base (415)..(415): a, c, t, g, unknown or other
  misc_feature (415)..(415): n is a, c, g, or t
  modified_base (431)..(439): a, c, t, g, unknown or other
  misc_feature (431)..(439): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggccggggaaccctggtcaccgtctcctcggcctccaccaggcccatcggtcctcccctggcgccctgcctccgaggacgccacctccgagagcacagccgcccctgggctgcctggcaagggcctacttccgagcgacgactggacgcgggntggcaaggcgcatagnnnnnnnnn

SEQ ID NO: 344016 - DNA, 470 bp, Homo sapiens
  misc_feature: GZ8MTXP02IREY1.21.60.F05.1.454.CMB.2.raw
  modified_base (456)..(470): a, c, t, g, unknown or other
  misc_feature (456)..(470): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttgaagttcgaccccgtggggccctgggaccctggtcaccgtctcctcggcctccaccaagggccccatccggtccttcccccgtgggccgcccctgcctccgaggacgccacctccgagacgcaacacgcccggcccctggggctggccctggtaccagggcctacgtcccgagccgacgactgagcgggctggacaagggcgcgacgtagnnnnnnnnnnnnnnn

SEQ ID NO: 344017 - DNA, 437 bp, Homo sapiens
  misc_feature: GZ8MTXP02JU94Q.21.60.F05.1.454.CMB.2.raw
  modified_base (406)..(406): a, c, t, g, unknown or other
  misc_feature (406)..(406): n is a, c, g, or t
  modified_base (432)..(437): a, c, t, g, unknown or other
  misc_feature (432)..(437): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaaccctggtcaccgtctcctcggcctccaccaagggccccatcggtcttccccctggccgcccctgctccaggagcacctccgagacgcacagcggccccctgggctgcctggtcaaggctactcccgagcgacnctgagcgggctggcaaggcgcatagnnnnnn

SEQ ID NO: 344018 - DNA, 436 bp, Homo sapiens
  misc_feature: GZ8MTXP02ITLGN.21.60.F05.1.454.CMB.2.raw
  modified_base (195)..(195): a, c, t, g, unknown or other
  misc_feature (195)..(195): n is a, c, g, or t
  modified_base (326)..(326): a, c, t, g, unknown or other
  misc_feature (326)..(326): n is a, c, g, or t
  modified_base (427)..(436): a, c, t, g, unknown or other
  misc_feature (427)..(436): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgactggttgaagttcgaccccgtggggcccggggaaccctggtcaccgtctcctcggcctccatcaagggcccatcggtcttcccccnggcgccctgcctccaggagcacctccgagagcacagccgccctgggctgcctgtcaggctactcccgagcgacgactgagcgggctggcaaggcgcatagnnnnnnnnnn

SEQ ID NO: 344019 - DNA, 453 bp, Homo sapiens
  misc_feature: GZ8MTXP02HLDH3.21.60.F05.1.454.CMB.2.raw
  modified_base (354)..(354): a, c, t, g, unknown or other
  misc_feature (354)..(354): n is a, c, g, or t
  modified_base (432)..(453): a, c, t, g, unknown or other
  misc_feature (432)..(453): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggcccggggaaccctggtcaccgtctcctcggcctccaccaggcccatcggtcttcccctggcgccctgctccaggagcacctcgagagcacngcggccccctggggctgcctggcaaggcctacttcccgagcgaacgctgacgcggggctgggcaagggcgtcaatggnnnnnnnnnnnnnnnnnnnnnn

SEQ ID NO: 344020 - DNA, 477 bp, Homo sapiens
  misc_feature: GZ8MTXP02HK63G.21.60.F05.1.454.CMB.2.raw
  modified_base (195)..(195): a, c, t, g, unknown or other
  misc_feature (195)..(195): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (455)..(477): a, c, t, g, unknown or other
  misc_feature (455)..(477): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggttgaagttccgacccgtggggcccgggacctggtcaccgtctcctcggcctccaccaggcccagtccggtccttcccccnggccgcccctgcctccaggacgccaccctccgagacnccacaggccggccccctggggctcgccgttggtacaagggcctacttcacgagccgacgacgtgagggcggcgtggacgaagggccganagtagnnnnnnnnnnnnnnnnnnnnnnn

SEQ ID NO: 344021 - DNA, 432 bp, Homo sapiens
  misc_feature: GZ8MTXP02HIBXI.21.60.F05.1.454.CMB.2.raw
  modified_base (215)..(215): a, c, t, g, unknown or other
  misc_feature (215)..(215): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (424)..(432): a, c, t, g, unknown or other
  misc_feature (424)..(432): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattacngtgctagacctagtggctcgtccgatggttgaagttccgaccccgtggggcccggggaaccctggtcaccgtctcctcggcctccaccaaggcccatcggtctccccngcnccctgctccaggncacctcgagagcacngccgcccctgggctgcctggcaaggctactcccgagccgacgactgacgcgggctggcaaggcgcatagnnnnnnnnn

SEQ ID NO: 344022 - DNA, 442 bp, Homo sapiens
  misc_feature: GZ8MTXP02IG51J.21.60.F05.1.454.CMB.2.raw
  modified_base (347)..(347): a, c, t, g, unknown or other
  misc_feature (347)..(347): n is a, c, g, or t
  modified_base (431)..(431): a, c, t, g, unknown or other
  misc_feature (431)..(431): n is a, c, g, or t
  modified_base (436)..(442): a, c, t, g, unknown or other
  misc_feature (436)..(442): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgaccccgtggggcccggggaaccctggtcaccgtctcctcggcctccaccaaggccccatcggtccttccccctggccgccctgctcccaggacncaccctcgagagcacagcggccccctgggctgcctggtcaaggctacttcccgagccgacgactggagcgggctggcaagggcncatgnnnnnnn

SEQ ID NO: 344023 - DNA, 446 bp, Homo sapiens
  misc_feature: GZ8MTXP02GCU8W.21.60.F05.1.454.CMB.2.raw
  modified_base (435)..(446): a, c, t, g, unknown or other
  misc_feature (435)..(446): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgatggttgaagttcgaccccgtggggcccggggaaccctggtcaccgtctcctcggcctccaccaagggcccatcggtctcccctggcgccctgctccaggacgcacctccgagagcacagcggccccctggggcctgcctggtcaacggctacttcccgagccgacgactggagcggggctggcaaggcgcatagnnnnnnnnnnnn

SEQ ID NO: 344024 - DNA, 487 bp, Homo sapiens
  misc_feature: GZ8MTXP02FPOSN.21.60.F05.1.454.CMB.2.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
  modified_base (466)..(466): a, c, t, g, unknown or other
  misc_feature (466)..(466): n is a, c, g, or t
  modified_base (469)..(487): a, c, t, g, unknown or other
  misc_feature (469)..(487): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggtgaagttccgaccccgtggggccgggaaccctggtcaccgtctcctcggcctccaccaaggccccatccggtcctccccctggccgcccctgcctccaggacncaccctccgagacgcacacggtccggccccccgtggggcctcgcccgtggtaccaagggtcctaccgttcccggagccgacgacgtgggacggccggggctcggaccgaagggcgactanagnnnnnnnnnnnnnnnnnnn

SEQ ID NO: 344025 - DNA, 458 bp, Homo sapiens
  misc_feature: GZ8MTXP02GH4LN.21.60.F05.1.454.CMB.2.raw
  modified_base (440)..(440): a, c, t, g, unknown or other
  misc_feature (440)..(440): n is a, c, g, or t
  modified_base (447)..(458): a, c, t, g, unknown or other
  misc_feature (447)..(458): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttcgaccccgtggggcccggggaaccctggtcaccgtctcctcggcctccaccaaggccccatccggtcctccccctggccgccctgcctccaggacgccaccctccgagacgcacgagccggccccctggggcctgcctggtcaacggctaccgtcccgagccgacgactgagcgggctggcaagggcncgatagnnnnnnnnnnnn

SEQ ID NO: 344026 - DNA, 543 bp, Homo sapiens
  misc_feature: GZ8MTXP02I6JYW.21.60.F05.1.454.CMB.2.raw
  modified_base (521)..(543): a, c, t, g, unknown or other
  misc_feature (521)..(543): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtggggcccgggaaccctggtcaccgtctcctcggccctccaccgaacgggccccagtccggtccttccccccgtggccgcccctgcctcccgaggacgccaccctccggagacgccacgacggccggccccccgtggggcctcggcccttggggtaccaaaacggggtcccttaacccgtttcccccggaaggcccgaaccgtacgtttgggacgggcccgggggctggggacccgaaacgggggccgaccgaagtaggnnnnnnnnnnnnnnnnnnnnnnn

SEQ ID NO: 344027 - DNA, 455 bp, Homo sapiens
  misc_feature: GZ8MTXP02IGQCZ.21.60.F05.1.454.CMB.2.raw
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (449)..(455): a, c, t, g, unknown or other
  misc_feature (449)..(455): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaacccgaggacacggccgtctattactgtgctagacctagtggctcgtccgactggttgaacgttcgaccccgtggggcccggggaaccctggtcaccgtctcctcggcctccaccaagggccccatccggtccttcccccgtggccgcccctgcctccgaggacgccaccctccgagacgcacagccggccccctgggcctgcctggtcaacgggtctacttcccgagccgacgactgagcgggctggcaggcncangnnnnnnn

SEQ ID NO: 344028 - DNA, 444 bp, Homo sapiens
  misc_feature: GZ8MTXP02FLPXF.21.60.F05.1.454.CMB.2.raw
  modified_base (194)..(194): a, c, t, g, unknown or other
  misc_feature (194)..(194): n is a, c, g, or t
  modified_base (288)..(288): a, c, t, g, unknown or other
  misc_feature (288)..(288): n is a, c, g, or t
  modified_base (434)..(444): a, c, t, g, unknown or other
  misc_feature (434)..(444): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgnggacacggccgtctattactgtgctagacctagtggctcgtccgactggttgaagttcgaccccgtggggccgggaccctggtcaccgtctccncggcctccaccaggcccatccggtcttccccctggccgcccctgctccaggcgcaccctccgagagcacagcggccccctgggcctgcctggtcaagggctacgtcccgagccgacgactgagcgggctggcaagggcacagtagnnnnnnnnnnn

SEQ ID NO: 344029 - DNA, 476 bp, Homo sapiens
  misc_feature: GZ8MTXP02INHK5.21.60.F05.1.454.CMB.2.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
  modified_base (458)..(458): a, c, t, g, unknown or other
  misc_feature (458)..(458): n is a, c, g, or t
  modified_base (464)..(476): a, c, t, g, unknown or other
  misc_feature (464)..(476): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctagaaaacccgnggacacggccgtctattactgtnctagacctagtggctcgtccgattggttgaagttccgaccccgtggggcccggggaaccctggtcaccgtctccgtcggcctccaccgaacggccccagtccggtcccttccccctggccgcccctgcctcccaggcnccaccctccgagacgcacagccggcccccgtgggctcgcctggtcaacgggcctaccgttcccgagccgaccgactggaggccgggctggacaaggggcncatagnnnnnnnnnnnnn

SEQ ID NO: 344030 - DNA, 463 bp, Homo sapiens
  misc_feature: GZ8MTXP02HLL56.21.60.F05.1.454.CMB.2.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
  modified_base (454)..(463): a, c, t, g, unknown or other
  misc_feature (454)..(463): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctagaaaaccgnggacacggccgtctattacngtgctagacctaggtggctcgtccgatggttcgaagttccgaccccgtgggggacccgggaaccctggtcaccggtctcctcggcctccaccaaggccccatcggtcctcccccgtggccgccctgcctccaggacnccacccgtccgagcgcacgacgccgccccgtggcctcgccgtgaccaaggcctaccgttccgagccgacgtacngacgcgggctggacgaggcgcaatcgnnnnnnnnnn

SEQ ID NO: 344031 - DNA, 454 bp, Homo sapiens
  misc_feature: GZ8MTXP02F08TC.21.60.F05.1.454.CMB.2.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (415)..(415): a, c, t, g, unknown or other
  misc_feature (415)..(415): n is a, c, g, or t
  modified_base (421)..(422): a, c, t, g, unknown or other
  misc_feature (421)..(422): n is a, c, g, or t
  modified_base (424)..(454): a, c, t, g, unknown or other
  misc_feature (424)..(454): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattacngtgctagacctagtggctcgtccgatggtgaagttcgacccgtggggccgggaacctggcaccgtctcctcgccnccacaggcccagtccgtctccccngccgccctgctccgaggcncacctccganacgcacngcggcccctgggctgcctggacaaggctctcccgagccgacatgaggcgggctggcaaacgggcnctaagnngnnnnnnnnnnnnnnnnnnnnnnnnnnnnnnn

SEQ ID NO: 344032 - DNA, 533 bp, Homo sapiens
  misc_feature: GZ8MTXP02HESI7.21.60.F05.1.454.CMB.2.raw
  modified_base (216)..(216): a, c, t, g, unknown or other
  misc_feature (216)..(216): n is a, c, g, or t
  modified_base (498)..(533): a, c, t, g, unknown or other
  misc_feature (498)..(533): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaacccgaggacacggccgtctattactntgctagacctagtggctcgtcgactggttgaagttccgaccccgtggggcccggggaaccctggtcaccgtctccgtcggcctccaccaggggccccagtccggtcctttcccccctggccgcccctgcctccgacggacgccaacccgtccgagacgccacgacggcggccccccgtggggcctcgaccgtggtaccgaacgggtcctaacccgttcccggagccgaacgacgtcgggacgggccgggggtctcgggaccgaacggggccgacgagtaggnnnnnnnnnnnnnnnnnnnnnnnnnnnnnnnnnnnn

SEQ ID NO: 344033 - DNA, 551 bp, Homo sapiens
  misc_feature: GZ8MTXP02GWIA4.21.60.F05.1.454.CMB.2.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (514)..(514): a, c, t, g, unknown or other
  misc_feature (514)..(514): n is a, c, g, or t
  modified_base (516)..(551): a, c, t, g, unknown or other
  misc_feature (516)..(551): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaagaacacggcgtatctgcaaatgagcagcctgaaaaccgnggacacggcctctattacngtgctagacctagtggctcgtccgatggttgaagttcgacccctggggcccggggaaccctggtcaccgtctcctcggcctccaccaaggccccagtccggtccttccccctggccgcccctgcctcccagggacgccaacccgtccgagtacggccaacgacggccggccccccctggggccttcggccccttggggtcccaaaggggtcccttacccgttcccccggaaaggcccaacccgggtactcggaacgggtcccgggggactcggggacaaacgggggccaccgaaattggngnnnnnnnnnnnnnnnnnnnnnnnnnnnnnnnnnnnn

SEQ ID NO: 344034 - DNA, 517 bp, Homo sapiens
  misc_feature: GZ8MTXP02JRH04.21.60.F05.1.454.CMB.2.raw
  modified_base (497)..(517): a, c, t, g, unknown or other
  misc_feature (497)..(517): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtggggccgggaccctggccaccgtctcctcggcctccaccgaacgggccccagtccggtccctttcccccgtggccgccccctgcctaccgagggacgccaaccccgtccggagacgccaacgacggccggccccccgtggggccttcggcccgttgggtaccaaagggtccctaccttccccggagccgacgacgtggacgggccgggggactgggacgaaacgggcgcagtagnnnnnnnnnnnnnnnnnnnnn

SEQ ID NO: 344035 - DNA, 468 bp, Homo sapiens
  misc_feature: GZ8MTXP02F0YRI.21.60.F05.1.454.CMB.2.raw
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (451)..(451): a, c, t, g, unknown or other
  misc_feature (451)..(451): n is a, c, g, or t
  modified_base (453)..(468): a, c, t, g, unknown or other
  misc_feature (453)..(468): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggacacggccgtctattactgtgctagacctagtggctcgtccgactggttgaagttccgaccccgtggggccgggaacctggtcaccgtctcctcggcctccaccgacggcccagtccggtcctccccgngccnccctgcctccgaggacnccaccctcgaganccacacggccggcccccgtgggctcgccgtgcaaggtcctacctcccggagccgacgacgtgacggcggggctggacaaagggccataagngnnnnnnnnnnnnnnnn

SEQ ID NO: 344036 - DNA, 494 bp, Homo sapiens
  misc_feature: GZ8MTXP02JYKRE.21.60.F05.1.454.CMB.2.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(494): a, c, t, g, unknown or other
  misc_feature (472)..(494): n is a, c, g, or t
tcagtcgtcgctcgcacgaccggtgctcgatttagtacgtcatcagggaaagggctggagtgggttggccgtattggaagcaaaaactaacaattacgcgacaacatatgctgcgtcggtgaaaggcaggttcaccatctccagagatgattcaaaagaacacggcgtatctgacaaatgagcagcctagaaaaccgaggacacggccgtctattacngtnctagactagngctcgtcgatggtgagttcgacccgtggggccgggaccctggtccnccgtctccgcgcctccaccgacggccagtcgtcctccccgnggccnccctgctccgaggcnccacctccgagacgcaacgcggccggcccccgtggggcctcggcccgtgggtaacccaaacgggtcctaccgttacccggagtaccgacgacctgggaacgggccggggctagggacgaacgggccganagngnnnnnnnnnnnnnnnnnnnnnnn

SEQ ID NO: 344037 - DNA, 492 bp, Homo sapiens
  misc_feature: GZ8MTXP02FN858.21.60.F05.1.454.CMB.2.raw
  modified_base (195)..(195): a, c, t, g, unknown or other
  misc_feature (195)..(195): n is a, c, g, or t
  modified_base (460)..(460): a, c, t, g, unknown or other
  misc_feature (460)..(460): n is a, c, g, or t
  modified_base (468)..(492): a, c, t, g, unknown or other
  misc_feature (468)..(492): n is a, c, g, or t
tcagtcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgnggacacggccgtctattactgtgctagacctagtggctcgtccgatggtgaagttccgaccccgtggggccgggaaccctggtcaccgtctcctcggcctccaccaacggcccatccggtccttcccccgtggccgcccctgcctccgaggcgcacccgtccgagacgccagacggccggccccctggggccttggccctgggtaccaagggtcctaccttcccggagccgaacgacgtcggagcggggctcgggacaagggccncaagtggnnnnnnnnnnnnnnnnnnnnnnnnn

SEQ ID NO: 344038 - DNA, 555 bp, Homo sapiens
  misc_feature: GZ8MTXP01AY8UQ.10.28.C06.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (363)..(363): a, c, t, g, unknown or other
  misc_feature (363)..(363): n is a, c, g, or t
  modified_base (536)..(536): a, c, t, g, unknown or other
  misc_feature (536)..(536): n is a, c, g, or t
tcagcatagtagtgcacgaccggtgctcgatttagagctcacgtattgggtttgggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctctggtaccaacagacccaggcaaagcccccaaatgatgatttangatgtcagtaatcgaccctnaggggtttcngatcgtcttcttcgcctcaagtctggacaacncggcctccctgaccatctcgtcgggctccagactggaggacgaggctgtattatactgcagctcaacataacgaagcggcgaggtcgggttgggtcggttcggggcgggggccaacgacgttcggaacccgttcgtagggtccaggccccaagggcctcgccccgtcggtccnccttcgttcgttaaccccc

SEQ ID NO: 344039 - DNA, 518 bp, Homo sapiens
  misc_feature: GZ8MTXP01BMHZ7.10.28.C06.1.454.CMB.2.raw
tcagcatagtagtgcacgaccggtgctcgatttagagctcacgtattgggtttgggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcgggggaggcttggtacagcctgggggtccctgagactctctgtgtagcgtctggattcacattcagtagttatagcatgaactggtccgcaggctccgagggaagggctggagtggttcatatatgatagaaatagtgaacatatactatgcagactctgtgagggcgattcacatctccagagacaatcgacaggtaattcactgtatgtaggaaatgaaacagtctggaagagccgaggacacggcttcgttcttattaactgtcgcgagacgtaaccccgaaaagtaacggg

SEQ ID NO: 344040 - DNA, 547 bp, Homo sapiens
  misc_feature: GZ8MTXP01DD5W2.10.28.C06.1.454.CMB.2.raw
  modified_base (367)..(367): a, c, t, g, unknown or other
  misc_feature (367)..(367): n is a, c, g, or t
tcagcatagtagtgcacgaccggtgctcgatttagagctcacgtattgggtttgggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaataatgaatatgtctcctggtaccaaacagtacccaggcaaacgccccaaaactgatgatttatgatgtcagtaatcgaccctgaggggtttctgatcgtcttctttcgcctcaagtctggcaaacncggcctccctgacctatctctgggctcagactgagacgaggctgattatactgcagcgtcaacaataacaaaggcggcgaggtcgggttgggtggttcgggcgggggacaacgacgttcggaccgttcgtaggtcacgccgaacggctccgccccgtcggtcacgtccttcgtaaccccc

SEQ ID NO: 344041 - DNA, 538 bp, Homo sapiens
  misc_feature: GZ8MTXP01D6P74.10.28.C06.1.454.CMB.2.raw
tcagcatagtagtgcacgaccggtgctcgatttagagctcacgtattgggtttggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagccccccaaatgatgatttatgatgtcagtaatcgaccctcgagggtttctgatcgcttctttgcctcaagtctggcacacggcctcctgaccccatctctgggctaccagctgaggacgaggctgattatactgcagctcacatacaagcggcagcggttgggtggttcgggggcgggggaccacgacgtcgaccgtccgtaggtcacgcccgaaggcctcgccccctcggttccaccgttctccgttccccacccttccttcccaactactaatcgcttgcgcgggtcg

SEQ ID NO: 344042 - DNA, 572 bp, Homo sapiens
  misc_feature: GZ8MTXP01EHFA3.10.28.C06.1.454.CMB.2.raw
  modified_base (374)..(374): a, c, t, g, unknown or other
  misc_feature (374)..(374): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagacccaggacaaacgcccccaaatgatgatttatgatgtacagtaatcgaccctgtaggggtttctgtatcgtcttctttcgcctacaagtctggaaccaacncggccctccctgacctatctcgtcgggctccagactggaggacgaggctagtattattactgcagctacacataacaagcggcgaggtcgggttgggtggtcgggcgggggaccaacgacgttcgaccgttcgtacggtacgacggcccgaacggtccgtccggccccgtccggtccaccttccttccgttaaccccc

SEQ ID NO: 344043 - DNA, 529 bp, Homo sapiens
  misc_feature: GZ8MTXP01BHMRE.10.28.C06.1.454.CMB.2.raw
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctctggtacaacagtacccaggcaaagccccaaactgatgatttangatgtcagtaatcgacctcgagggtttcngatcgcttcttcgcctcaagtctggcaacncggccctccctgacctatctctcgggctcagactgagacgagctgtattattactgacagctacacataacaagcgcaggcggttgggtggttcgggcgggggaccaacgacgttggaccggttcgtacggtcacgccaggtcctcgcccctcggcaccgtcttcgtcccc

SEQ ID NO: 344044 - DNA, 544 bp, Homo sapiens
  misc_feature: GZ8MTXP01BAV9Y.10.28.C06.1.454.CMB.2.raw
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcacatctcctgcactggacccacagttacattggtaataatgaatatgtctctggtaccaacagtacccaggcaaacgccccaaatgatgatttangatgtcagtaatcgaccctgagggtttctgatcgtcttctttcgcctcaagtctggacaacncgcctccctgaccatctcgtcggctccgagactgaggacgaggctgattatactgacagctacacatacaagcgcgaggtcgggttgggtggttcgggcgggggaccaacgacgttcgaccgttcgtacgtcgacgcccgacggcctccgccccgtcggtccttacgtccgttccgttccccc

SEQ ID NO: 344045 - DNA, 528 bp, Homo sapiens
  misc_feature: GZ8MTXP01A7Z0L.10.28.C06.1.454.CMB.2.raw
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
  modified_base (427)..(427): a, c, t, g, unknown or other
  misc_feature (427)..(427): n is a, c, g, or t
  modified_base (513)..(513): a, c, t, g, unknown or other
  misc_feature (513)..(513): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagacccaggcaaacgcccccaaactgatgatttangatgtcagtaatcgaccctgaggggtttctgatcgcttctttcgcctcaagtctggacaacncggcctccctgaccatctctgggctcagactgaggacgaggctagattattactgcagctcanatacaagcgcaggtcggttgggtggttcgggcgggggacaacgacgttcgacgttcgtaggcacgccaaggctcgccccgcggtcnctcgttcgttccccg

SEQ ID NO: 344046 - DNA, 519 bp, Homo sapiens
  misc_feature: GZ8MTXP01A0J7Q.10.28.C06.1.454.CMB.2.raw
  modified_base (311)..(311): a, c, t, g, unknown or other
  misc_feature (311)..(311): n is a, c, g, or t
  modified_base (456)..(456): a, c, t, g, unknown or other
  misc_feature (456)..(456): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttggtacagccgtggggggtccctggagactctcctgtgtagcgtctggattcacattcagtagttatagcatgaactggggtccncaggctccgaggggagggctggagtgggttcatatattgatagaaatagtggaaaccataatactatgcagactctgtgagggccgattcaccatctcagagacatgccaggattcactgtatgtgaaatgaaacagtctagagnggccgaggacacggctcgtcttattcttgtgcgtaagacgacccgaaaagtcgggttctaacg

SEQ ID NO: 344047 - DNA, 541 bp, Homo sapiens
  misc_feature: GZ8MTXP01C17SY.10.28.C06.1.454.CMB.2.raw
  modified_base (388)..(388): a, c, t, g, unknown or other
  misc_feature (388)..(388): n is a, c, g, or t
  modified_base (422)..(422): a, c, t, g, unknown or other
  misc_feature (422)..(422): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctgggtgggaggtcgggggggaggcttgggtacaggccgtggggggtccctggagactctcctgtgtagcgtctggattcacattcagtagttatagcatgaactgggtccgcaggctccgaggggagggggctggagtgggttcattatatgataagaaataagtgaaccatanactatgcagactctgtggaggggcattcacatcncagagacaatcgacgaggaattcactgtatggtaggaaatgaaacagtctgaagacgccggaggaccgacggcttcttnttacttcngtcgcgagacgtaaccccgaaaagttaacggg

SEQ ID NO: 344048 - DNA, 562 bp, Homo sapiens
  misc_feature: GZ8MTXP01DFH93.10.28.C06.1.454.CMB.2.raw
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
tcagcatagtagtgcacgaccggtgctcgatttagagctcacgtattgggtttggggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacacgtacccaggacaaaacgccccccaaaatgatgatttangatgtcagtaatcgaccctcgtaggggtttctgatcgcttctttcgcctcaagtctggaccaacncggcctcctgaccatctcgngggcctcagacgtgaaggacgaaggctagtattattactgacagctacacactaacgaagcgagaggtcggtgggtggttcgggcgggggaccaacgacgttcgtaccgttcgtaggtcacgccgaacggctaccgtccccgtcggtcacttccgttccgtttccccc

SEQ ID NO: 344049 - DNA, 628 bp, Homo sapiens
  misc_feature: GZ8MTXP01ACO7C.10.28.C06.1.454.CMB.2.raw
  modified_base (338)..(338): a, c, t, g, unknown or other
  misc_feature (338)..(338): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacacgtacccaggcaaacgcccccaaactgatgatttatgatgtcagtaatccgacctcgtaggggtttcngatcgctttctttcgcctcaagtctcggacaacgcggcctccctgaccatctcgtgggctcgagacgtggagacgaggctagtattattactgactacgctcaactactaacgaacgcggacgacggttccggggtttcgggggtcggttaccgggggaccggggggaacccaacggtaccgttacgggtacccgttaccggtaacgggttccgaaccggaccccggaacggggtcccttccggccccccgttcgggtacccaccgtttccttcccggtttaaccccccc

SEQ ID NO: 344050 - DNA, 533 bp, Homo sapiens
  misc_feature: GZ8MTXP01CK96Q.10.28.C06.1.454.CMB.2.raw
  modified_base (377)..(377): a, c, t, g, unknown or other
  misc_feature (377)..(377): n is a, c, g, or t
  modified_base (458)..(458): a, c, t, g, unknown or other
  misc_feature (458)..(458): n is a, c, g, or t
  modified_base (496)..(496): a, c, t, g, unknown or other
  misc_feature (496)..(496): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctgggtggaggtcggggggagcttgggtacagccgtgggggtccctgagactctcctgtgtagcgtctggattcacattcagtagttatagcatgaaactggggtccgccagggctccgaggggaagggggctggagtgggtttcatatattgatagaaatgtggaaaaccataanactatgcagactctgtgagggcgattcaccatctccagagacaatgaccaaggaattcactgtatagtaggaaatgaaacngtactagagacgcgaagaacacggctctcttattaccngtgcgaagacgaccccggaaaatcggggttcttaacg

SEQ ID NO: 344051 - DNA, 528 bp, Homo sapiens
  misc_feature: GZ8MTXP01AW2RB.10.28.C06.1.454.CMB.2.raw
  modified_base (304)..(304): a, c, t, g, unknown or other
  misc_feature (304)..(304): n is a, c, g, or t
  modified_base (483)..(483): a, c, t, g, unknown or other
  misc_feature (483)..(483): n is a, c, g, or t
tcagcatagtagtgcacgaccggtgctcgatttagagctcacgtattgggtttggggagctctcagagaggtgccttagccctggattccaaggcatttccacctggtgatcagcacttaacacagaggactcaccatggagttggggctgtgctgggttttccttgttgctattttagaaggtgtccggtgtgaggtgcagctggtggagtcgggggaggcttggtacagcctggggggtccctgagactctcctgtgtagcgtctggattcacattcagtagtatagcatgaactgggtccncaggctccgagggaaggggctgggagtgggtttcatatatgatagaaatgtaggaaccaatataactatgcagactctgtgagggccgattcaccatctcagagacaatgccaggaattcactgtatgtaggaaatgaacagtctgagagccgaaggacacgggcttcgtctattacgngttcgcgagaacgaccccgaaaattcggggtaacttaacggtaac

SEQ ID NO: 344052 - DNA, 564 bp, Homo sapiens
  misc_feature: GZ8MTXP01ANH6S.10.28.C06.1.454.CMB.2.raw
  modified_base (371)..(371): a, c, t, g, unknown or other
  misc_feature (371)..(371): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagtaccccaggcaaacgcccccaaactgatgatttatgatgtcagtaatcgaccctgagggggtttctgatcgctttctttcgcctcaagtctggacaacncggccctccctgaccatctctgggctcagactgaggacgaggctgattattactgacagctcataactaacaaacaacctaaagtctttagactagttcggacgggtagggaacccaaacgttcgaacccgttccgttcgtcacgcccaagggtcctccggccccctcggtcttacctccgttcgttcccccg

SEQ ID NO: 344053 - DNA, 529 bp, Homo sapiens
  misc_feature: GZ8MTXP01ASZLR.10.28.C06.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagtaccccaggcaaaagcccccaaaactgatgatttangatgtcagtaatcgaccctnaggggtttcngatcgcttctttgcctcaagtctggacaacncggcctccctgaccatctctgggctccagactgagacgagctgattattactgcagctcacatacaagcggcagcgggttgggtggttcgggcgggggaccaacgacgttgaccgttcgtaggtcacgcccaggctcgcccctcggcacgtcttcgttcccc

SEQ ID NO: 344054 - DNA, 540 bp, Homo sapiens
  misc_feature: GZ8MTXP01ANEOX.10.28.C06.1.454.CMB.2.raw
  modified_base (368)..(368): a, c, t, g, unknown or other
  misc_feature (368)..(368): n is a, c, g, or t
  modified_base (471)..(471): a, c, t, g, unknown or other
  misc_feature (471)..(471): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaatgatgatttatgatgtcagtaatccgaccctcgaggggtttctgatcgcttctttcgcctcaagtctggacaacncggccctccctgaccatctctcgggctcagactgaggacgaggctagattattactgacagctcacatacaagcgcaggtcggtggtggtcgggcgggggacncgacgttcggaccgttcgtacggtcacgccacggtctccgccccgtcggtccactccgttcgttccccc

SEQ ID NO: 344055 - DNA, 561 bp, Homo sapiens
  misc_feature: GZ8MTXP01C7H2F.10.28.C06.1.454.CMB.2.raw
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaaataatgaaatatgtctcctggtaccaacagtacccaggacaaacgccccaaatgatgatttangatgtcagtaatcgacctgtaggggttctgatcgtcttcttcgcctcaagtctggacaacncgcctccngaccatctctcggctcagactgaggacgaggctgattattactgacacgctacacatacaagcgcgaggtcgggttgggtcggttcgggcgggggaaccaacgacgcgtaaccgttccgtaaggtccgaacgcccgaacgggcctccggcccccgtttcggccttaccttccttccgtttaaccccc

SEQ ID NO: 344056 - DNA, 558 bp, Homo sapiens
  misc_feature: GZ8MTXP01DKEKH.10.28.C06.1.454.CMB.2.raw
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaaataatgaatatgtctcctggtaccaacagtacccaggcaaacgcccccaaatgatgatttatgatgtcagtaatccgaccctgtaggggtttctagatcgtctttctttcgcctcaagtctggacaacncggcctccctgaccatctcgtgggctcagactgaggacgagctgtattattacngacagctcaacataacgaagcgcgaggtcgggttggggtgggttcggggcgggggaccaacgcgttcgaccgttccgtacggtcacggccaacggccgtaccgccccgtcggtcaccgtccgttcgttccccc

SEQ ID NO: 344057 - DNA, 527 bp, Homo sapiens
  misc_feature: GZ8MTXP01AUMPH.10.28.C06.1.454.CMB.2.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaaatatgtctcctggtaccaaacagtaccccaggcaaagcccccaaaatgatgatttangatgtcagtaatcgaccctcagggggtttcngatcgctttctttcgcctcaagtctggcaaacncggcctccctgacccatctctgggctccagactgaggacgaggctgattattactgcagctcacatacaagcggcagcggttgggtgttcggcgggggacaacacttgacgttcgtaggcacgccaggctcgcccctcggtcactcttcgtcccc

SEQ ID NO: 344058 - DNA, 527 bp, Homo sapiens
  misc_feature: GZ8MTXP01ADJOP.10.28.C06.1.454.CMB.2.raw
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagctggtggaggtcggggggagcgttggtacaggccgtggggggtccctgagactctcctgtgtagcgtctggattcacattcagtagttatagctatgaacgtggggtccgccaggctcgagggaggggctggagtggtttcatatattgatagaaatagtgaaaaccataatactatgcagactcgtgtgagggctatcacatctcaganacatgacaggaatcaacgtnatgtagaatgaacngtcngagagccgagcgacggctcgtacttacgttacttggtgacgaacgtacggaccccgttaaagtcgggttcttaacg

SEQ ID NO: 344059 - DNA, 560 bp, Homo sapiens
  misc_feature: GZ8MTXP01D66OR.10.28.C06.1.454.CMB.2.raw
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaaacagtacccaggacaaagcccccaaactgatgatttatgatgtcagtaatcgacctnaggggtttcngatcgcttctttcgcctcaagtctggcaacncgcctccctgaccntctctgggctccagactgaggacgaggctagattattactgctagactctacatacaagcggcgtaggcggttgggtcggttcgggcggggggacccaacgaccgttcggaaccgttccgtaggtccacggcccaacgggccctcggtccccctcggtccttaccgtcccttcgtttccccc

SEQ ID NO: 344060 - DNA, 552 bp, Homo sapiens
  misc_feature: GZ8MTXP01DB4S6.10.28.C06.1.454.CMB.2.raw
  modified_base (473)..(473): a, c, t, g, unknown or other
  misc_feature (473)..(473): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctgggtgggaggtcggggggaggcgttggtacaggccgtggggggtccctgagactctcctgtgtagcgtctggattcacattcagtagttatagcatgaactgggtccgccgaggctccgaggggaggggcgtggaggtggtttcatatattgatagaaatagaggaaacataatactatgcagactctgtgaggggcctagttcacctatacctccaagacgaacaatcgaccaaggaatttcgaacttagtaatggtagaaatgaaacngtactagacgaggaacgaggacgacggctactnttagttacnggtgcgaagacgaccaaggtaaaacgttgggttaacc

SEQ ID NO: 344061 - DNA, 534 bp, Homo sapiens
  misc_feature: GZ8MTXP01DW89L.10.28.C06.1.454.CMB.2.raw
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaggtgtccggtgtgaggtgcagctggtggaggtcggggggagcgttgggtacaggccgtggggggtccctgagactctcctgtgtagcgtctggattcacattcagtagttatagcatgaactggggtccgcaggctcgaggggagggctggagtggtttcagtatattagatagaaatagtggaaaccataatactatgcagactgtgtggaggggccattcaccatctcaganacaatgaccaggacttcattgtangtaggaatgaaactagtctgagngaacccgaagaaccacggttctcttcttaatttcagtggaccgaaggacgacccgaaaagtcgggttcttaacg

SEQ ID NO: 344062 - DNA, 642 bp, Homo sapiens
  misc_feature: GZ8MTXP01DFM93.10.28.C06.1.454.CMB.2.raw
  modified_base (305)..(305): a, c, t, g, unknown or other
  misc_feature (305)..(305): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactgacccacagttacattggtaaataatgaatatgtctcctggtaccaacagacccaggacaaacgcccccaaatgatgtatttangatgtcaagtaatccgacctgtaggggtttctgtatcgtctttcttcgccctactaagtctcggaacctaaacgcccggtccctaccctagaacccctacgtccttcgtcggggacccttacgaacgtacgtagaagggacggaaggtctagtatttactactgcacgctacaactactaacgacggtacggcgagggttcgggttggggttcgggttccgggggaccgggggacctaacgtcgttcggtacccgttacgttaacggtcgaaccgttcccgaacggtccgtacccgtccccgtcgggtccttaccgttccgttcccggttccccccg

SEQ ID NO: 344063 - DNA, 644 bp, Homo sapiens
  misc_feature: GZ8MTXP01B7VC6.10.28.C06.1.454.CMB.2.raw
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagacccaggacaaacgcccccaaactgatgtatttatgatgtacagtaatcgacccttcgtagggggtttctgactcgtctttctttcgccttacgaagtctggaacctaacgaaccggtccctcccctgaccctacttctcgtcgggacctcgaagtactggaacggacgaggtctagtattattacngacacgctcgaacataaccgaaggccggngaggtccggggttgggtcgggttaccgggggaccgggggacccaacggtaccgttcggtacccggttcgtacgggtccaccggacccgaacggggtccctacccgggtcccccgttacgggtccttaacccgttcccgttcccgtttaacccccc

SEQ ID NO: 344064 - DNA, 557 bp, Homo sapiens
  misc_feature: GZ8MTXP01ETQLB.10.28.C06.1.454.CMB.2.raw
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctggtcccagtctgccctgactcagcctgcctccgtgtctgggtctcctggacagtccatcaccatctcctgcactggacccacagttacattggtaaataatgaatatgtctcctggtaccaacagtaccccaggacaaacgacccccaaactgatgatttatgatgtcagtaatcgaccctgtagggtttcngtatcgctttcttcgcctcagtctggacacgcgctccngaccatctctggctcagacgtgaggacgaggctagtattattactgacagctcatatacgaagcgcgaggtcggttggggtcggttcggggacgggggccaacgtcgttcgtaccgttccgtagtcacgcccgaggtcctccgtcccccgtggtccttacgttccgttaaccgttccccc

SEQ ID NO: 344065 - DNA, 612 bp, Homo sapiens
  misc_feature: GZ8MTXP01C01O4.10.28.C06.1.454.CMB.2.raw
  modified_base (312)..(312): a, c, t, g, unknown or other
  misc_feature (312)..(312): n is a, c, g, or t
tcagcatagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatccaccatcctcctgcactcggacccactagttacattggtaaataatgaatatgtctcctggtaccaaacacgtacccaggacaaacgccccaaactgatgatttangatgtcaagtatccgacctcgtaggggtttctgtactcgtctttcttcgcctacgagtctggaacaacgcgccctccctgactatctcgtcggcctacgagtacgtggaaggacgacggtctagtaattaacttcgtacgctacgtccgttacaactaacgtaaaccgaagccgggtacgagggtccggggttggggtacggttcggggaccgggggtaccaacgtacgttcggtaccgttcgtacggtcgacgcccgaacgccgtccgccccgttgccttacttccgttcgttcccccg

SEQ ID NO: 344066 - DNA, 554 bp, Homo sapiens
  misc_feature: GZ8MTXP01DVO2C.10.28.C06.1.454.CMB.2.raw
  modified_base (315)..(315): a, c, t, g, unknown or other
  misc_feature (315)..(315): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtcggtgtgaggtgcagctgggtggaggtcggggggagtcgttggtacaggccgtggggggtccctggagactctcctgtgtagcgtctggattcactattcagtagttatagcatgaactcggggtccncgaggctaccgagggggaagggctggaggttggtttcatatattagaataagaaatagtaggaaaaccataatactatgacagactgtgtgagggcatcacatctcagagacatgaccaagtaacttcatagtagtgtaggaaattgaaacagtcagagagccgaagaacgacggctacgtcttagttaccttgtaagacgaacggaccgacccgaaaaagtcggggttaacgttaacg

SEQ ID NO: 344067 - DNA, 538 bp, Homo sapiens
  misc_feature: GZ8MTXP01DPAP9.10.28.C06.1.454.CMB.2.raw
  modified_base (365)..(365): a, c, t, g, unknown or other
  misc_feature (365)..(365): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
tcagcatagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttataactatgtctctggtaccaacaacaccaggcaaacgccccaaactcatgtattttgatgtcagtaatcggcctcgtaggggtttctaatcgcttctctggcctcaagtctggcaaaacnccggccctccctcgaccatctcgtcgggctccgagctgaggacgaggctgattatactgcagctanataactacaacagcagctacttntagtacgttcgggcggaaggaccaagcttcgaccgtcttacggttcacgcccgaggcctcggccccttcggtccaacgttcccg

SEQ ID NO: 344068 - DNA, 582 bp, Homo sapiens
  misc_feature: GZ8MTXP01B5ZLN.10.28.C06.1.454.CMB.2.raw
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccaccagttacattggtaaataatgaatatgtctcctggtaccaacagacccaggcaaacgcccccaaaatgatgatttatgatgtcaagtaatcgaccctgtaggggtttcngatcgtcttctttcgcctcaagtctggacaacncggcctcctcgaccatctctacgggctccagactgacggacgagctagtattagttactgcacgctacaacactaacgaaggcggacgtaggtcggggttcggggtcgggttcggggaccgggggtaccaaccgtacgttcgtacccgttcgtacggtcacggcccaacgggtcctccgccccgtcggtcacctccgttccgtaaccccc

SEQ ID NO: 344069 - DNA, 603 bp, Homo sapiens
  misc_feature: GZ8MTXP01C3SL8.10.28.C06.1.454.CMB.2.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaaataatgaaatatgtctcctggtaccaacagacccaggacaaacgacccccaaatgatgtatttatgatgtcaagtaatccgaccctgtaggggtttctgactcgtctttctttaccgcctactaagtcgtggaaccaaccgccggtccctcccgtacgacctactcctcgtcgggtcctaccgacgacgtggaggacgagtctagtacttattaccgtgacacgtctacaactaataacgaaggcggacgacgggtcgggttggggtacggtccggggaccgggggaccaacgtacgttcgacccgttcgtacggtcacgcccgaggccgtccgccctcggcttactccgttcgttccccc

SEQ ID NO: 344070 - DNA, 579 bp, Homo sapiens
  misc_feature: GZ8MTXP01CMM96.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcagcatggagttggggctgtgctgggttttccttgttgctattttagaaggtgtccggtgtgaggtgcagctgggtggaggtcggggggaggcgttgggtacaggccgtggggggtccctggagactctcctgtgtagcgtctggatcacattcagtagttatagcatgaacgtggtccgccaggctccgagggggaaggggcgtgggtaggttgggtttcagttattattggataagaaataggtaagggaaaccctaagtaataactatgcagactcgtgtggacggggtccattccaccatcctacagacgacaatgaccaaggggtattcactagtagtgtaggaaatgaaactgtctggaagcgaaccgagaacgacggtactcttaccttattaccgttggcgccggaacggacgttaaccccgaaaagttcggggtaacc

SEQ ID NO: 344071 - DNA, 575 bp, Homo sapiens
  misc_feature: GZ8MTXP01BCRY2.10.28.C06.1.454.CMB.2.raw
  modified_base (321)..(321): a, c, t, g, unknown or other
  misc_feature (321)..(321): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagctgggtgggagggtcgggggggaggtcgttggtacaggccggtggggggtccctgagactctcctgtgtagcgtctggattcactattcagtagttatagcatgaacgtcgggtccncgaggctaccgagggggaaggggcgtgggtaggttgggtttacattatattagatagaaatagtaggaaaacataatactatgactagactcgtggtggacggggcctattcactatctcagagacaatcgacagatcagtgtatgtagaaatgaactgtcaggaagcgaaccggaagaaccgtacggcttacgtacttacgttcgttggtgacggaagacccgaacccggttaaaagtcggggttaactaacg

SEQ ID NO: 344072 - DNA, 619 bp, Homo sapiens
  misc_feature: GZ8MTXP01BWOPY.10.28.C06.1.454.CMB.2.raw
  modified_base (322)..(322): a, c, t, g, unknown or other
  misc_feature (322)..(322): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggaggtcggggggaggtcgttggtacaggccgtggggggtccctggagacctctcctgtgtagcgtctggattcactattcagtagttatagcatgaacgtggggtcccnccgaggcctaccgagggggaaggggctgggaggttgggtttacattatagttgaataagaaatagtagaaaaccataatactatgacagactcgtgtggaggggcctattccaccatcctaccaagacgaacaagtcgaacccgtaaggtaacttctaacgttgtaagtaggtaaggaaaattgaaacctgtacgtagacgaacgaaccggaagaaaccgaccggccttacgtaccttaagttccgttggtaacgacggaagaaccgaaccccgttaaaagtcgggttaacctaacg

SEQ ID NO: 344073 - DNA, 514 bp, Homo sapiens
  misc_feature: GZ8MTXP01AH6BQ.10.28.C06.1.454.CMB.2.raw
  modified_base (304)..(304): a, c, t, g, unknown or other
  misc_feature (304)..(304): n is a, c, g, or t
  modified_base (477)..(477): a, c, t, g, unknown or other
  misc_feature (477)..(477): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttccttgttgctattttagaaggtgtccggtgtgaggtgcagctggtggagtcgggggagcttggtacagccgtggggggtccctgagactctcctgtgtagcgtctggattcacattcagtagttatagcatgaactgggtccnccaggctcgaggggagggctggagtggttcagtatattgatagaaatagtgaaaccataatactatgcagactctgtgaggggcattcaccatctccagagacatgccaggattcactgtagtgtagaaatgaaacagtctagagagccgaagaacacggctctcttagttcnggtgcgaagacgacccgaaaagtcgggttaactaacg

SEQ ID NO: 344074 - DNA, 588 bp, Homo sapiens
  misc_feature: GZ8MTXP01A38Y8.10.28.C06.1.454.CMB.2.raw
  modified_base (372)..(372): a, c, t, g, unknown or other
  misc_feature (372)..(372): n is a, c, g, or t
  modified_base (446)..(446): a, c, t, g, unknown or other
  misc_feature (446)..(446): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagacccaggacaaacgcccccaaatgatgtatttatgatgtacagtaatcgaccctgtaggggtttctgatcgtctttcttcgcctacaagtctaggaccaacnccggccctccctgacctatcctcgtgggcctccagactggacggacgaggctagattattactgacagctacanaactacgaaggcgcgaggtcgggttgggtcggttcgggggcgggggtacaacgtcgttcggtacccgttcgtaggtccaccggcccgaacgggtcctcccggtcccccgtcgggtccaccgttcccgttccggttccccccg

SEQ ID NO: 344075 - DNA, 597 bp, Homo sapiens
  misc_feature: GZ8MTXP01A28NZ.10.28.C06.1.454.CMB.2.raw
  modified_base (558)..(558): a, c, t, g, unknown or other
  misc_feature (558)..(558): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggagggtcgggggggaggtcgttgggtacaggtccggtggggggtccctggagcctctcctgtgtagcgtctggattcactattcagtagttatagcatgaacgtgggtcccgccgaggctccgagggggaagggggcgtgggaggttgggtttcattatattgataagaaatagtacggaaaaccataatactatgcagactctgtggaggggcctattccaccagtcctaccagacaacaacgtacgaccgaaggtacttcgaacgttgtagtagtaaggaaatacgaaacgtgtctaggaacgcgaaccgggaggacgacggctcgttattacgttcgttggngacgaagaccggacccgttaaagtccggttaacgtaacg

SEQ ID NO: 344076 - DNA, 566 bp, Homo sapiens
  misc_feature: GZ8MTXP01DPXBM.10.28.C06.1.454.CMB.2.raw
  modified_base (320)..(320): a, c, t, g, unknown or other
  misc_feature (320)..(320): n is a, c, g, or t
  modified_base (399)..(399): a, c, t, g, unknown or other
  misc_feature (399)..(399): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagcgtggtgggagggtcggggggaggtcgttggtacaggccgtggggggtccctgagtactctcctgtgtagcgtctggattcactattcaagtagttatagcatgaacgtgggtcccnccaggctccgaggggagggctgggagttggtttcatatatgatagaaatgtagaaaccataatactatgcagactgtgnggaggggccattcaccatctccagagacaatgaccaggacttcatgtatgtaagaatagaactgtcgtagagacggaaccgaaagaccgacggctacttacttacgtttcgcggttgacggaacgaaaccggacccccggttaaaagtcggggttaacttaaaccgg

SEQ ID NO: 344077 - DNA, 605 bp, Homo sapiens
  misc_feature: GZ8MTXP01ANPWP.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttgggctgtgcttgggttttccttgttgctatttagaaggtgtccggtgtgaggtgcagcgtggtgggaggtcggggggagtcgttggtacaggccgtggggggtccctggagtactctcctgtgtagcgtctggattcactattcagttagttatagctagtgaacgtggggtcccgccaggcctaccggagggggaaggggctgggtaggttggtttacatattagttagaataagaaatagtaggaaaacctagtaataactatgacagtactcgtgtaggacgggtctagtccaactattccgacaagacaacagtcgacgtaaggtaacttctacgttagtagtaggtaagtaagtagaaacgtgtcgtaggagacggcgtaagaccgacggttctacgttacttagttcgttggtcgacgtaacgaaccgaaccccgaaagttcgttaacgtaaccg

SEQ ID NO: 344078 - DNA, 788 bp, Homo sapiens
  misc_feature: GZ8MTXP01C900D.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggttttccttgttgcttattttagaaggtgtcggtgtgaggtgcagctggtggaggtcggggggagcgttggtacaggccgtgggggtccctgagactctcctgtgtagcgtctggattcactattcagttagttatagctagtagaacgtcggggtcccgccgaggcctaccggaagggggaacgggggcgttaggggtaaggttggggtttacaatttaacgttagtttaggaaagttaaaggaaaagttaagggtaacggaaccctaattaaacttactaagtcgacaagtaccttcgttggtagggacgggggtcctagtttacccaacctacgttcctaacccgaagaacgaaccaaacgttacgacccggtaaagggttaaactttccgtaaaccgttaggttaacgttagggttaagggtaaaaaagttacggtaaaacccgtagggttaccgttaacgggaaagggtaaacccggacccggggtaaacggaaacccggtaacccgggttacctttaccgtttacgttttaaacgtttaacccgtagggttaacggaaccgggtaaacggaacccgggtaaaccccccgttaaaaaagggttttaacccgggg

SEQ ID NO: 344079 - DNA, 591 bp, Homo sapiens
  misc_feature: GZ8MTXP01DCRSQ.10.28.C06.1.454.CMB.2.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (543)..(543): a, c, t, g, unknown or other
  misc_feature (543)..(543): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctatttagaaggtgtccggtgtgaggtgcagcgtgggtgggaggtcggggggaggtcgttggtacagccgtggggggtccctgagactctcctgtgtagcgtctggattcacattcagtagttatagcatgaactgggtccgcaggctcgaggggaggctggngtggttnatatatgatagaaatagtagaaacctataatactatgacagtactgtggtaggacggggacctagttaccacctactccgtaccaagacgaacaagtcgaccaagggtaacttacgacgttagtaatggttaaggaaattagaaacctgtcgtaggaaggtacggaaccggaaggaccacggccttcttaccttagtttcgnggtaacgacgaaggtaccgaacccgttaaaggttcgggttaactaacg

SEQ ID NO: 344080 - DNA, 602 bp, Homo sapiens
  misc_feature: GZ8MTXP01B9D6H.10.28.C06.1.454.CMB.2.raw
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattggtaataatgaatatgtctcctggtaccaacagacccaggaccaaacgcccccaaactgatgtatttangatgtacagtaactcgaccctgtagggtttctgactcgtcttcttcgcctcagtctgacacncgcctccngaccntctcgtggctcgagcgtggaggacgaggctagtattacttactgacacgctacacatacgaaggccggcgaggttcggggttggggttcgggttccggggccgggggtaccaacggtacgttcggtacccggttccgtacgggtccgacggccccgacgggtccccgtccggtcccccgttcgggtccttaccgttcccgtttcccgttaaccccccg

SEQ ID NO: 344081 - DNA, 596 bp, Homo sapiens
  misc_feature: GZ8MTXP01DHCIU.10.28.C06.1.454.CMB.2.raw
  modified_base (311)..(311): a, c, t, g, unknown or other
  misc_feature (311)..(311): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttcctgttgctatttagaaggtgtccggtgtgaggtgcagctgggtgggaggtcggggggaggcgttggtacaggccgtggggggtccctgagactctcctgtgtagcgtctggattcactattcagtagttatagcatgaactgggtccncgaggctacgaggggaggggctggagttggtttacatatattgataagaatagtaggaaaacctataatactatgcagactcgtggtggaggggcctattccacctatctaccaagacgaacaaagtcgaaccaagggtaactttcgacttagtataggtaagaaattgaaacgtgtcgtaggagacggaaccggaaggactaccgggcttccgtcttaacgtttcgttaggtcggacggaacggaccggtaaccccggttaaaagttcggggttaacttaaccg

SEQ ID NO: 344082 - DNA, 537 bp, Homo sapiens
  misc_feature: GZ8MTXP01BRZM2.10.28.C06.1.454.CMB.2.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (377)..(377): a, c, t, g, unknown or other
  misc_feature (377)..(377): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggaggtcggggggaggcttggtacagccgtggggggtccctgagactctcctgtgtagcgtctggattcacattcagtagttanagcatgaactgggtccncaggctcgagggagggctggagtggttcatatatgatagaatagtgaacatatactatncagactctgtgaggggccattcacatctccagagacaatgaccgaggtaattcacttgtatggtaggaaatgaaactagtctggaacgagccggaaggacgacggtcttcgttcttattaacgtgtgacggtagacggtaaccccgaaaagttaaccggg

SEQ ID NO: 344083 - DNA, 576 bp, Homo sapiens
  misc_feature: GZ8MTXP01C11EG.10.28.C06.1.454.CMB.2.raw
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctctggacagtccatcaccatctctgcactggacccacagttacattggtaataatgaatatgtctctggtaccaacagacccaggacaaacgccccaaatgatgtatttangatgtcagtaancgacctgtaggggttctgatcgtctttcttcgcctacaagtctggacaacncggcctccngaccatctctcggctcagactgagacgaggtctgtattatactgacagctacaactataacgaagcgcgaggtcggggttgggtggttccggggccgggggacctaacgtacgttcggtaccgttcgtaagggtcacggcccgaagggtccctcccggtcccccgttcgggtaccttaccgttccttcccggttaacccccc

SEQ ID NO: 344084 - DNA, 627 bp, Homo sapiens
  misc_feature: GZ8MTXP01A8T09.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttccttgttgctatttagaggtgtccggtgtgaggtgcagctgggtgggaggtcggggggaggcgttgggtacaggccgtggggggtccctggagactctcctgtgtagcgtctggattcactattcagtagttatagcagtgaacgtggggtcccgcgaggcctccgagggggaggggctgggtagtgggtttcatatattgatagaaatagtaggaaaacctataatactatgacagactcgtggtggaggggccgtattccactacgtcctaccagacgaacaagtcgaccgtaaggtaacttctacgttgtaagtaggtaaggaaattcggaaactggttaccgtaggacggacggaaccgggaacggaccgtacgggttcttacgtaccgtttagttaccggttggtaacggacggaacggtaaccggaaccccggttaaaagttcggggttaaccttaaccg

SEQ ID NO: 344085 - DNA, 678 bp, Homo sapiens
  misc_feature: GZ8MTXP01EWA38.10.28.C06.1.454.CMB.2.raw
  modified_base (333)..(333): a, c, t, g, unknown or other
  misc_feature (333)..(333): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggttttccttgttgcttattttagaaggtgtccggtgtgaggtgcagcgtgggtgggagggtcggggggaggtcgttggtacaggccggtggggggtccctgagactctctgtgtagcgtctggattcactattcagtagttatagcagtgaacgtggggtcccncgaggctccggagggggaaggggcgtgggaggttgggtttacattattagttagaagtaaagaaattaaggtacggaaacctattaaattactagtgactaagtacttcgtggtagggacgggggacctacttaccaaccgtatcctaccgaagacgtaaacaagtacggaccgaagggtaacttaccgagttagtagtaggtaaggaaatgaaacgtgtacgtaggaacggaacggaccgggaaggacccgtacgggtaccttaccttcgtttaactttaacggttacggtcgaaccgggaacggttaacccgggtaaaccccgttaaaaggtttaacccgggg

SEQ ID NO: 344086 - DNA, 559 bp, Homo sapiens
  misc_feature: GZ8MTXP01C3GL6.10.28.C06.1.454.CMB.2.raw
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctgggtgggaggtcggggggagcgttggtacaggccgtgggggtccctgagactctcctgtgtagcgtctggattcacattcagtagtatagcatgaactgggtccncagctcgagggaggctggagtggttcatatatgatagaatagagaaaccataanactatgcagactcgngtgagggccgatcgacatctaccagaanacatcgacagtacttcagttagtagtagtaagaaatagaacgtagtcgagacgacgggaaccggaaggacgtacgcgttacgtacttaacgttcgttaggtaacgaccgaacggaacccgtaaacccggttaaaagttaaccgggttaactaag

SEQ ID NO: 344087 - DNA, 540 bp, Homo sapiens
  misc_feature: GZ8MTXP01BLEBS.10.28.C06.1.454.CMB.2.raw
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggaggcttggtacagccgtggggggtccctgagactctcctgtgtagcgtctggattcacattcagtagttatagcatgaactgggtccgcaggctccgaggggaagggctggagtggtttcatatatgatagaaatagtgaaaccataatactatgcagactctgtagggcattcacatctaccaganacaatgccaggaattcgattgtatgtagaaatgaacagtctgagngccggaaggaccncgggtcttcgtacttaacttacgttcggttagcgacggaacgaccccggaaaattacggggtcttaaccggtaa

SEQ ID NO: 344088 - DNA, 606 bp, Homo sapiens
  misc_feature: GZ8MTXP01DYE3B.10.28.C06.1.454.CMB.2.raw
  modified_base (389)..(389): a, c, t, g, unknown or other
  misc_feature (389)..(389): n is a, c, g, or t
  modified_base (440)..(440): a, c, t, g, unknown or other
  misc_feature (440)..(440): n is a, c, g, or t
tcagcatagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactgacccacagttacattggtaaataatgaatatgtctctggtaaccaacagacccaggaccaaacgaccccaaatgatgatttatgatgtacaagtaatccgacctcgtaggggtttctgatcgtcttctttcgcctacaagtctaggaaccaaacgccggccctccgnacctatctcgtcgggctccgagacgtgacggacgagctagtattattacgnacacgactacactaactaacgaggcggcgtacgggtcggggttgggtcgggtaccgggggaccggggacctaacgtacgttacggtaccgttacgtacggtaccgacgacccgacggtccctcccggtccccgttcgtaccttaccgttcccgttcccgtaacccc

SEQ ID NO: 344089 - DNA, 566 bp, Homo sapiens
  misc_feature: GZ8MTXP01AP3VC.10.28.C06.1.454.CMB.2.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
  modified_base (431)..(431): a, c, t, g, unknown or other
  misc_feature (431)..(431): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaanagacccaggcaaacgccccaaactgatgatttangatgtcagtaatcgacctgaggggtttcngatcgtcttctttcgcctcaagtctggacaacncgcctccctgaccatctcgtcgggctccagactgaggacgaggctgtattattactgcagctacanactacgaagcggcgaggtcgggttagggtggtcggggcgggggaccaacgtacgcggtaccgttccgtaagggtcacggcccgaacggtcctccggtcccccgttcgggccttaccgtcgttcccggttcccccg

SEQ ID NO: 344090 - DNA, 527 bp, Homo sapiens
  misc_feature: GZ8MTXP01D5P7P.10.28.C06.1.454.CMB.2.raw
  modified_base (314)..(314): a, c, t, g, unknown or other
  misc_feature (314)..(314): n is a, c, g, or t
  modified_base (455)..(455): a, c, t, g, unknown or other
  misc_feature (455)..(455): n is a, c, g, or t
  modified_base (491)..(491): a, c, t, g, unknown or other
  misc_feature (491)..(491): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagctgggtgggaggtcggggggaggcttggtacaggccgtggggggtccctgagactctcctgtgtagcgtctggattcacattcagtagttatagcatgaaactggggtccnccaggctccgagggaaggggctggagtggtttcatatatgatagaaatagtgaaaaccataatactatgcagactctgtgagggcgattcacatctccagagacaatgaccaggaattcactgtatgtaggaaatgaaacngtctgagagccgaggacgacggctctcttagttacngtgcgaagacgacccgaaaagtcgggttaactaacg

SEQ ID NO: 344091 - DNA, 519 bp, Homo sapiens
  misc_feature: GZ8MTXP01AG5OQ.10.28.C06.1.454.CMB.2.raw
  modified_base (311)..(311): a, c, t, g, unknown or other
  misc_feature (311)..(311): n is a, c, g, or t
  modified_base (483)..(483): a, c, t, g, unknown or other
  misc_feature (483)..(483): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttggtacaggccgtggggggtccctggagactctcctgtgtagcgtctggattcacattcagtagttatagcatgaactgggtccncaggctcgaggggagggctggagtggtttcatatattgatagaaatgtgaaacataatactatgcagactctgtgaggggccattcacatctcagagacaatcgaccaggaattcacttgtatgaggaaatgaacagtctagagagccgaagactcggctctcttagttacnggtgcgaagacgaccccgaaaagtcgggttctaacg

SEQ ID NO: 344092 - DNA, 695 bp, Homo sapiens
  misc_feature: GZ8MTXP01EWY3Q.10.28.C06.1.454.CMB.2.raw
  modified_base (315)..(315): a, c, t, g, unknown or other
  misc_feature (315)..(315): n is a, c, g, or t
  modified_base (650)..(650): a, c, t, g, unknown or other
  misc_feature (650)..(650): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtggtgggaggtcggggggagcgttggtacagccgtggggggtccctgagactctcctgtgtagcgtctggattcacattcagtagttatagcatgaacgtcggggtccnccgaggcgtaccggagggggaagggcgtagggtaggttgggtttacagttagtagtttagaagttaaagaaaagtaggttaacggaaaaaccctaattaacgttaaacttagtcgacctaaggtaccgttcgttagggtacggggaacgggggtccctaactttaccgaacccgtaattacccgtaaccgaaggaaacgaactaaacgtcgaacccgaaggttaaactttcgaaacgtttagtaagttaggtaaggaaaattggaaaaccgtgttgtaggaacggacggaacccggaaggttaaccgaccggttcctacgttacttagtttacgnggtaacgacgaacggaaccgtaaccgttaaagtcggttaactaag

SEQ ID NO: 344093 - DNA, 544 bp, Homo sapiens
  misc_feature: GZ8MTXP01EGC8Z.10.28.C06.1.454.CMB.2.raw
  modified_base (306)..(306): a, c, t, g, unknown or other
  misc_feature (306)..(306): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctatttagaggtgtcggtgtgaggtgcagctggtggaggtcggggggagtcttggtacaggccgtggggggtcctgagctctctgtgtagcgtctggattcactattcagtagttatagcatgaactggggtccncgaggctacgagggggaaggggctggagtgggtttcatatattagataagaaatagtaggaaaaccataatactatgcagctctggtgaggggcctattcacatctaccagagacaatgacctaggaattcaattgtaatggtaggaaatggaaacagtctagagagaaccgaagacgacggctactcttagttacttgtaagcgaagtacgacccgaaaagtcgggttaacttaacg

SEQ ID NO: 344094 - DNA, 641 bp, Homo sapiens
  misc_feature: GZ8MTXP01COVMR.10.28.C06.1.454.CMB.2.raw
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaataatgaatatgtctctgtaccaacacgaccaggaccaaacgaccccaaatgatgtatttangatgtcaagtaactcgacctcgtaggggtttctgattcgtctttctttccgcctcagtctggaacaacnccggccctccctacgacctatccgtcgtcgggcttcgaagacgtggacggaacggaggtccttagtactttacttacgtcgacacgtctacaaactaactaacgaaggccggtacgagggtccggggtttcggggtcgggttccgggggaccgggggaactaacggtaacgttcggtaccccggttcgttaaacgggcaaccgcccggttaaacggccctacccggcccccttcgggtaccttaccgttccgttcccgttaacccccc

SEQ ID NO: 344095 - DNA, 701 bp, Homo sapiens
  misc_feature: GZ8MTXP01BYL6S.10.28.C06.1.454.CMB.2.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctgtaaccaacagtacccaggacaaacgacccccaaatgatagtatttatgtatgtcaagttaactccgtacccctgtacggggtttctagtactcgtctttcttccgccctacgtaagtcctcggaaccaaaccgtcccgggtcccttcccgtaccgaacccctattcccgttcgtacggggtcccttaccgaacggtaccgtagggaacgggacccggtaagggtaccgttagtaacgttttaacttaccgtggacctacggtctaacgtaaactaacgtaacccgaaagggccggacgaggtccgggggtttggggtaccgggttcggggaccgggggacctaacgtcggttaccggtaccgttccgttacgggccaccggttcccgaacggtccgtcccgtcccccgttcggtccgaccttccgttccgttcccccg

SEQ ID NO: 344096 - DNA, 745 bp, Homo sapiens
  misc_feature: GZ8MTXP01DB7JT.10.28.C06.1.454.CMB.2.raw
  modified_base (338)..(338): a, c, t, g, unknown or other
  misc_feature (338)..(338): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttctgtgctatttagaggtgtcggtgtgaggtgcagctgggtgggaggtcggggggggagtcgttgggtacgacggtccgggtcggggggtccctggacggtaccttccgtccgtggtgtagtcgtcgtggtattcactattacaagttagttatagctagtcgaacgtcggggtcccncgaggcctaccggagggggaagggtcgtagggaggtttgggtttacaagttatagttagaataaagaaattaggtacgaaaacctataatactatgacagtactgtgggtacggacggggtcctaattccaacctaatccctaccgaagggtaacaaaccaagtcggaaccgtaaagggtaaactttccgtaaagtttaggttaagttagggtaaagtaaaacgttaggaaaaaccgtggttaccgtaagggaacggaacgggtaaccccggtaaaagaaacccggtaaaccggggttcctttaaccttacggtttaaactttccggttgggttcggaaccggtaacggtaaccccgggaaaacccccggttaaaaaggttcccgggggttaacctttaaaaccggg

SEQ ID NO: 344097 - DNA, 617 bp, Homo sapiens
  misc_feature: GZ8MTXP01D5GGE.10.28.C06.1.454.CMB.2.raw
  modified_base (322)..(322): a, c, t, g, unknown or other
  misc_feature (322)..(322): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagctgggtgggagggtcggggggagtcgttgggtacgaggccgtggggggtccctgagtactctcctgtgtagcgtctggattcactattcagttagttatagcatgaacgtgggtcccncgaggctcgaggggagggctggagtggtttcagtatattgataagaaatagtaggaaaaccataagtactatgacagactcgtgtggacggggtcctattccactagtacctccgaagacgaacaatcgaccgtaaggtaacttccaagtttgtaagttggtaaaggtaaataggaaaccgtgttaccgtagggacgacgggaaccggaagaaaccgacggttcttacctactttagttaccttggtgaccggaacggacggaaccccggttaaaagttccgggttaacttaacg

SEQ ID NO: 344098 - DNA, 645 bp, Homo sapiens
  misc_feature: GZ8MTXP01EGDX7.10.28.C06.1.454.CMB.2.raw
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaaatntgtctctggtaccaacagacccaggacaaacgccccaaatgatgatttangatgtcaagtaatccgacctcgtaggggtttcngtatcgtctttcttcgcctacaagtctggaacaacncggcctccctgacctntctcgtcgggcctacgagacgtgaggacgaggcttagtattattacgtgacagtctacaactaacttaacgaaaggccgggcgtaacgggtccgggggtttggggtcggggtttaccgggggccggggggtaacccaacgtaccgttacgggtaaccccggttccgtaacgggtccgaacggccccgttaaacgggtccccgttcccggcccccgttcgggtcccttaccgttcccgttcccggtttaacccccccg

SEQ ID NO: 344099 - DNA, 537 bp, Homo sapiens
  misc_feature: GZ8MTXP01CBRAA.10.28.C06.1.454.CMB.2.raw
  modified_base (310)..(310): a, c, t, g, unknown or other
  misc_feature (310)..(310): n is a, c, g, or t
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
  modified_base (530)..(530): a, c, t, g, unknown or other
  misc_feature (530)..(530): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaggtgtccggtgtgaggtgcagctgggtggaggtcggggggaggcttggtacaggccgtggggggtccctggagactctcctgtgtagcgtctggattcacattcagtagttatagcatgaactgggtccnccaggctcgagggagggctggagtgggttcatatattgatagaaatagtggaaacctataatactatgcagactctgtgaggggccattcaccatctcagagacagtgccaggactttcacttgtatgtaggaaatgaaacgngtcgtgagngcccgaggacaccgggctcgtcttacgttacttggtgcgaagacgaccccggaaaataaccggggttnttaaccg

SEQ ID NO: 344100 - DNA, 592 bp, Homo sapiens
  misc_feature: GZ8MTXP01ESAYX.10.28.C06.1.454.CMB.2.raw
  modified_base (317)..(317): a, c, t, g, unknown or other
  misc_feature (317)..(317): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaggtgtccggtgtgaggtgcagctgggtgggaggtcggggggaggcgttggtacaggtccgtggggggtccctggagtactctcctgtgtagcgtctggattcactattcagttagttatagcatgaacgtgggtccncgaggctacgaggggaggggctgggtaggttggtttcagtattagtgaataagaaagtgtaggaaaaccagtaatactatgcaagtactcgtggtcgggacggggtccgtatccgacctattcctaccgagtaacgacaaagtcgacctaaggtactttacagttgtaagtgtaaggaatgaaactgtcgagacgacggcgaaggttaccgacgttctctaattgttcttggtcgacggtaacgacgaacccgttaaagtcgggttaacttaacg

SEQ ID NO: 344101 - DNA, 551 bp, Homo sapiens
  misc_feature: GZ8MTXP01AZ8IR.10.28.C06.1.454.CMB.2.raw
  modified_base (312)..(312): a, c, t, g, unknown or other
  misc_feature (312)..(312): n is a, c, g, or t
  modified_base (502)..(502): a, c, t, g, unknown or other
  misc_feature (502)..(502): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttggtacagccgtggggggtccctgagactctcctgtgtagcgtctggattcacattcagtagttatagcatgaactggggtccnccgaggctccgaggggaggggctggagtggtttcatatattgatagaaatagtagaaaccataatactatgcagactctgtggagggccgatcacatctccagagacaatgaccaaggacttcactgtatgtaggaatagaactgtctaggagaggcccggaaggaccgacggctacgtcttagttacgnggtaacgcggtaagaccggaaccccgttaaaagttcgggttaactaacg

SEQ ID NO: 344102 - DNA, 576 bp, Homo sapiens
  misc_feature: GZ8MTXP01CGPXR.10.28.C06.1.454.CMB.2.raw
  modified_base (311)..(311): a, c, t, g, unknown or other
  misc_feature (311)..(311): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtcggtgtgaggtgcagctgggtggaggtcggggggaggcttggtacaggccgtggggggtccctgagactctcctgtgtagcgtctggattcacattcagtagttatagcatgaactcggggtccnccgaggctaccgaggggaaggggctggagtggttcatatatgatagaatagaggaaaccataatactatgacagactacgtgtggaggggccgattcgacctacgtctaccagagacaatcgaccgaaggtaacttctacgttagtagtaggttaggaaaagttgaaacgtagtcgtagaggagaacccggaaggacgaacggctacgtcttaacgttacttgtgacgaagaccgacccggttaaaagtcgggttaacttaaccg

SEQ ID NO: 344103 - DNA, 615 bp, Homo sapiens
  misc_feature: GZ8MTXP01CWKDG.10.28.C06.1.454.CMB.2.raw
  modified_base (305)..(305): a, c, t, g, unknown or other
  misc_feature (305)..(305): n is a, c, g, or t
  modified_base (383)..(383): a, c, t, g, unknown or other
  misc_feature (383)..(383): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaatgatgtatttangtatgtcaagttaactccgaccctcgtagggggtttctgtactcgtctttctttcgcctacgaagtctggaaccaacnccggccctccctgaccatctcgtgggcctaccgagacgtggacggacggagtctagtattattactgcagtctacacaactacgaagcggacgtaggtcggggttggggtcggttaccggggcgggggtaccaacgtcgttacggtaccgttccgttacgggcaccggcccgaacgggccctcccggcccccgttcgggtaccttcccgttccgttcccggttaaccccccg

SEQ ID NO: 344104 - DNA, 556 bp, Homo sapiens
  misc_feature: GZ8MTXP01BIOOB.10.28.C06.1.454.CMB.2.raw
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttccttgttgctatttagaggtgtcggtgtgaggtgcagctggtgggaggtcggggggaggtcgttggtacgaggccgtggggggtccctggagactctcctgtgtagcgtctggattcactattcagtagttatagcatgaacgtggggtccgccgaggctaccggagggggaggggctgggaggttgggtttacattatattgataagaaagtagtagaaaaccataatactatgacagtactcgtgtggaggggcattcacatctcagagacatgacagattcagtgtatgtagaactgaaacngtctagagacggcgagaccacggctctcttagtttccgnggtcgacggtaacgaccggtaccccggttaaaagtcggggttaacctaacg

SEQ ID NO: 344105 - DNA, 820 bp, Homo sapiens
  misc_feature: GZ8MTXP01D3XY4.10.28.C06.1.454.CMB.2.raw
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctctgcactggacccacagttacattaggtaaataatgaatactgtctcctaggtaaccaacacgtaacccaggacaaaccgcccccaaatgatgtattangatgacataactccgacctgtaggtttngatcgtctttcttcgacctaccaagttccgtaggacctaaaccgacccggtccccttccccgtacgtaccccctacgttcgtccggtcgggccccttaacccgaagtaaccggttagggaaacgggtaccgggtaacgggtctttaagggtaattttaacgttaacttacggtaccaacggttacctaaccaaacccgttaaaacgtaaacggaacgggtacgggtacggtacggggttacgggggtttacgggggtaccggggttacccgggggggggaaccgggggtaaaccctaccggtaaccggttaccggtaacccggttaccggttaccggtacccgtaacccggtaccccgtaaccggtcccgttccccggtcccccggtttccggttacccgttacccgtttccccgtttaccccgtttcccccgttacccccgttccccgttacccttaacccgttacgttaaccgttaccggtcggttaccgggtaaccgggttccgggtaaccgg

SEQ ID NO: 344106 - DNA, 696 bp, Homo sapiens
  misc_feature: GZ8MTXP01CBNRG.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggagggtcggggggagtcgttggtacgaggccggtcggggggtccctggagaccttctcctgtgtagcgtctggtattcactattcagttagttatagcagtgaacgtcgggtcccgcgacggcctccggagggggaagggggtcgtagggaggttgggtttacattattattacgaataagaaagtaggtacgaaaacctataatactagtcgacagtacttcgtggtacggacgggggtccctagtttacccaacctacgttaccctaccgaaagaacggtaaccaagtcgaccgaaaggttaaactttctaacgttgttaagttaggtaaaggaaacttagaaaccgtgttaccgagaacggaacggaaccgaaacgttaaccgaaccggttcttaccgttacttaacgtttccgttggtaacggaccggaacgacccgggtaaccccgttaaaaagggttccggttaaccgttaaaaccg

SEQ ID NO: 344107 - DNA, 570 bp, Homo sapiens
  misc_feature: GZ8MTXP01AGG9T.10.28.C06.1.454.CMB.2.raw
  modified_base (316)..(316): a, c, t, g, unknown or other
  misc_feature (316)..(316): n is a, c, g, or t
  modified_base (528)..(528): a, c, t, g, unknown or other
  misc_feature (528)..(528): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaggtgtccggtgtgaggtgcagctgggtgggaggtcggggggaggtcttggtacgaggccgtggggggtccctggacgactctcctgtgtagcgtctggattcacattcagtagttatagcatgaactggggtccncaggctcgaggggagggctggagtggtttcatatattgatagaaatgtagaaaccataatactatgacagactcgtgtggaggggtccagttccaccatcctaccaagacgacaatcggacccaaggaactttcaacgttgtaatggtaggtaaatggaaactagtctaggacgaggcccggaaggccgaccggcttcctacgttatttcgngtaaggcgaagaccgaccccggaaagtcgggttaacctaacg

SEQ ID NO: 344108 - DNA, 598 bp, Homo sapiens
  misc_feature: GZ8MTXP01EX5PC.10.28.C06.1.454.CMB.2.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctctggtacaacagaccagacaaacgccccaaatgatgtatttangatgtacagtaactcgtacctgtagggtttcngtatcgtctttcttcgcctacagtctcggaacaacnccgcctcctagacctatctcgtcgggtcctacgagacgtaggaggacgaggtctagtatttatacgtgactacgctacaactaataacgaaggcggacgtagggtcgggttggggtacggttcgggggaccgggggaccaacgtacgttcggaccgttccgtacggtacgacgcccgaacggtccgtccgtcccccgttcggtccaccttccgttcccgttaaccccc

SEQ ID NO: 344109 - DNA, 555 bp, Homo sapiens
  misc_feature: GZ8MTXP01AYHLO.10.28.C06.1.454.CMB.2.raw
  modified_base (317)..(317): a, c, t, g, unknown or other
  misc_feature (317)..(317): n is a, c, g, or t
  modified_base (469)..(469): a, c, t, g, unknown or other
  misc_feature (469)..(469): n is a, c, g, or t
  modified_base (513)..(513): a, c, t, g, unknown or other
  misc_feature (513)..(513): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgtgctatttagaggtgtcggtgtgaggtgcagctgggtggaggtcggggggaggcgttggtacaggccgtggggggtccctgagactctctgtgtagcgtctggattcactattcagtagttatagcatgaactgggtccncgaggctccgaggggagggcgtggagtgggttcatatattgatagaaataagtaggaacatatactatgcagactctggtggacggggcattcacctatcctacagagacaagtcgacgaggtattccagtgtatgtagaaatgaacagtcnggaagacggccgaggaccgacggtccttcgttacttattaacgnggtcgacggaacgaccggtaacccgttaaaaggttaaccggg

SEQ ID NO: 344110 - DNA, 620 bp, Homo sapiens
  misc_feature: GZ8MTXP01B0V3T.10.28.C06.1.454.CMB.2.raw
  modified_base (311)..(311): a, c, t, g, unknown or other
  misc_feature (311)..(311): n is a, c, g, or t
  modified_base (400)..(400): a, c, t, g, unknown or other
  misc_feature (400)..(400): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctcgtgtctgggtctctggacagtccatcacatctcctgcactcggacccactagttacattggaaataatgaatatgtctcctaggtaaccaacacgacccaggaccaaacgacccccaaatgatagtatttangatgacaagtaactcgtaccctgtagggtttcagactcgtcttcttcgcctacaagtctacggaacaaaccgcgtcctaccctgacctntcgtcgtgggcctaccgaagtacgtggaacggtacgaggtactagtaattactactgactancgtanaactagtaacgaacgcggcgtagggtcgggttggggtcgggttaccggggcggggaacctaacgacgttcgggaacccgttcgtacgggcaaccggccgaacgggtcctacccggccccgttcgggccttaccttccgtttaacccgtccccc

SEQ ID NO: 344111 - DNA, 634 bp, Homo sapiens
  misc_feature: GZ8MTXP01CO8CK.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttcctgttgctatttagaggtgtccggtgtgaggtgcagctggtggaggtcggggggaggcgttggtacaggccgtggggggtccctgagactctcctgtgtagcgtctggattcactattcagtagttatagcatgactgggtccgcgaggctccgagggggaagggcgtggagttggttcagtatatgatagaataagtagaacatatactatgcagactcgtgtggacggggctattaccaacctatcctaccaagaacgaacaagtcgaccgtaagggtaacttacgtacgttagtagtggtaagtaaaacgtgtaaacgtaggtccgtagggaacgaacggccggtaaagggaccgtaaccgggtcttaccgttacgtttaacgtttaaccggtgggttaacggaaccgggtaacggaaccccgggtaaacccccgggttaaaaaggtttaacccgggg

SEQ ID NO: 344112 - DNA, 585 bp, Homo sapiens
  misc_feature: GZ8MTXP01DBO7X.10.28.C06.1.454.CMB.2.raw
  modified_base (321)..(321): a, c, t, g, unknown or other
  misc_feature (321)..(321): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttgggctgtgcttgggttttccttgttgctatttagaggtgtccggtgtgaggtgcagcgtgggtgggaggtcggggggagtcgttggtacacggtccggtggggggtccctggagactctccgtgtgtagcgtctggattcactattcagttagttatagctatgaactcggggtccnccaggctaccggagggggaagggctagggaggttggtttcagtatattacgatagaaatgacgaaaccataactactatgacagactctggtgagggcctatcacatcacagacgacatgaccaagacttcagtgtagtaggtaagaaatgaaacagttcgaggagacggaaccgaacggaccgacggttcttacgtactttagtttccgttggttcgacggaacgaaacccggacccgttaaaagtcggggttaacttaaccg

SEQ ID NO: 344113 - DNA, 656 bp, Homo sapiens
  misc_feature: GZ8MTXP01AHT8R.10.28.C06.1.454.CMB.2.raw
  modified_base (415)..(415): a, c, t, g, unknown or other
  misc_feature (415)..(415): n is a, c, g, or t
  modified_base (537)..(537): a, c, t, g, unknown or other
  misc_feature (537)..(537): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttcctgttgctattttagaaggtgtccggtgtgaggtgcagcgtgggtgggagggtcggggggagtcgttgggtacgacggtcccggtgggggggttcccctggacgtacttcctccgtggtgtagcgttcgtggattcacattcgaagtattatagcatagaacgtcggggcccgcgacggccgtaccggaagggggaagggtcgtgggtaggttggttacattatagtagaataagaatagtagaaaccatntatatgacagtcgtcgtggtacggacggggtacctattaccacctactcctaccgaagacgaactaagcggtaaccaaggtaacttcgtaagttgtagttaggaaggtaaatagtaaaccgngtaccgtaggacgcggaaccggaagaccgcggttattcccctaagtttcgttaccgttggtaacggaccgaacggtaaccccgaaacccggttaaaggtttaaccgggttcttaaaccg

SEQ ID NO: 344114 - DNA, 531 bp, Homo sapiens
  misc_feature: GZ8MTXP01EU45Y.10.28.C06.1.454.CMB.2.raw
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggagggtcggggggaggtcgttgggtacgaggccggtggggggtccctggagactctcctgtgtagcgtctggattcacattcagtagttatagcatgaactgggtccgccaggctccgaggggagggctggagtggtttcatatatgatagaaatagtagaaaccataatactatgcagactcgtgtgaggggcattcacatctccagaganatgaccaggattcactgtatggtagaaattgaaacngtctagagagcccggaagacgacggctctnttattcngtgcgaagacgacccgaaagtcgggttctaacg

SEQ ID NO: 344115 - DNA, 620 bp, Homo sapiens
  misc_feature: GZ8MTXP01AESWG.10.28.C06.1.454.CMB.2.raw
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattggtaaataatgaatatgtctcctggtaccaacagtacccaggacaaacgcccccaaaactgatgtatttatgatgtacagtaatcgacctgtagggtttcngatcgtcttcttcgcctcagtctggacaacncgcctcccgnaccntctctcgggctcagactgacggtacgaggctgtattattacgtagcacgctacaactactaacgaacggcggctacggggttccggggttgggggttcgggttaccgggggccggggggaaccctaacggtaccgttcggtaaaccccggttcgtaaccgggttcgaccggccccggaacggtcccgtcccgtcccccgttcgggtcccttccgttcccttcccggtttccccccc

SEQ ID NO: 344116 - DNA, 548 bp, Homo sapiens
  misc_feature: GZ8MTXP01B86XY.10.28.C06.1.454.CMB.2.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
tcagcatagtagtgcacgaccggtgctcgatttagagctcacgtattgggtttgggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggacaaacgccccaaatgatgatttangatgtcagtaatcgacctgtagggtttcngatcgtcttctttcgcctcaagtctggacaacncggcctcctgaccatctctcgggctcagactgaggacgaggctgtattattactgcagctcaacataacgaagcgcgaggtcgggttggggtggttcgggcgggggaccaacgacgttcggaccgttcgtaaggtcacggcccgaggtcctcgtccccgtcggtcacctccgttcgttccccg

SEQ ID NO: 344117 - DNA, 605 bp, Homo sapiens
  misc_feature: GZ8MTXP01EQZ9F.10.28.C06.1.454.CMB.2.raw
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggacaaacgcccccaaactgatgatttatgatgtcagtaatcgaccctcgtaggggtttctgtatcgtcttctttcgccttacaagtcctggaccaacncggcctccctgacccatctntcgggctccagactgaggacgagggcttgattattactgactacgctacacataacgaaacgtcggaccgtaggcggggtttgggtcgggttacggggccggggggtaaccaacgtaccggttacggtcccggttccgtaagggttcacggccccgaaacgggtcctccggtcccccgtcggtccgttaccttccgttccgtttccccccg

SEQ ID NO: 344118 - DNA, 627 bp, Homo sapiens
  misc_feature: GZ8MTXP01ANLCB.10.28.C06.1.454.CMB.2.raw
  modified_base (297)..(297): a, c, t, g, unknown or other
  misc_feature (297)..(297): n is a, c, g, or t
tcagcatagtagtgcacgaccggtgctcgatttagagctcacgtattgggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattatacttgtctctgatcaacaacgccagacaacgccccacactcttgtattangaagtcagtaacgcgtcctgtaggggtttctagtcgccttctctcgcctacaaacgtcgtggtaccaaccgaccggcccctacctacgaaactactccgtcgtcgggcctaccgacggcgtacggaacgtaccggaggtactagtaaattacgttacgtcgggacacgtctacgtaagttagtgtaaggtatcgggtactcctttacgtttacggttaaacggggttttcgggacggggtaaacgggaccgtacgggtccttacgggttacccgttaccgtaacgtccgaaccgacccggacggttcccgtcccgttcccccgttaacgg

SEQ ID NO: 344119 - DNA, 581 bp, Homo sapiens
  misc_feature: GZ8MTXP01A0835.10.28.C06.1.454.CMB.2.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaaccaacagacccaggacaaacgccccaaatgatgatttangatgtcaagtaatccgaccctgtaggggtttctgacttcgtctttctttcgccttacaagtctggaaccaacnccggccctccctgaccctatctcgtcgggctccgagactggacggacgaggcttagtattattactgacacgctacaactataacgaagcggcgtacgggtcggggttggggtcgggtcggggccgggggtaccaacgacgttcgtaccgttcgtacggcgacgccgacggctccgccccgtcggcttactccgttcgtcccc

SEQ ID NO: 344120 - DNA, 689 bp, Homo sapiens
  misc_feature: GZ8MTXP01CGQX0.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagcgtgggtgggaggtcggggggaggtcgttgggtaccgaggcccggtggggggtcccctggacgtaccttctcctggtgtagcgtctggattcactattcagtagttatagcatgaacgtcggggtccgccgaggcctccggaagggggaacgggggtccgtagggtaggtttggggttttacaagttagttagtttaggaattaaggaaaagttaggtacggaaaacctagttaactactagtgacagtactcgtggtagggacgggggacctattccaacctattaccctacgaacgacgaacctaagtcgaccgaggtaactttcgaacgtttgtaattaggtaaggaaacttggaaactgtacgtaggaaggaacggaaccggaaagaaccgacgggttctaccttcgttaacgtttcgttggttcgaccggtaacggaaccggtaaccccggttaaaaggttccgggttaacgtttaaaccg

SEQ ID NO: 344121 - DNA, 689 bp, Homo sapiens
  misc_feature: GZ8MTXP01DDPZ4.10.28.C06.1.454.CMB.2.raw
  modified_base (251)..(251): a, c, t, g, unknown or other
  misc_feature (251)..(251): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactgacccacagttacattggtaataatgaatntgtctctgtaaccaacacgacccaggacaaacgaccccaaactgatgtatttatgatgtacaagttaactccgtacccgtcggttagggggtttctagtacttcgtctttccgtttccgcccttacgtaagtctacggaaccaaaccgtcccggcccttccccgtagaaccctacttccgtcgtcgggtacccttaccgaagtacgtagggaacggtaccggaggtcttagtaatttactacgtcggacacgtactacaactaagtaaccgaaaggccggtcgtaggggttccgggggtttcgggggtttccgggggaccgggggtaaccacggtaacgttcggttacccgtaccgttacggtccgaaccggttaccgacggttccgtaacccgccccgttaaggtccctaccttccgttcccgttcccctaaccccg

SEQ ID NO: 344122 - DNA, 681 bp, Homo sapiens
  misc_feature: GZ8MTXP01DN04U.10.28.C06.1.454.CMB.2.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccactagttacattggtaataatgaaatatgtctcctggtaccaaacacgtacccaggaccaaaacgacccccaaatgatgtatttaatgatgtacaagtaactccgaccctcgtaggggtttctgtacttcgtctttctttcgcccttacaagtccgtacggaacccaaaccgtccggcccttcccgtagacccctattccgtcggtcgggccttaccgaaggtaccgtaggacgggtaaccggaaggtcgttagtaatttacttaacgtgacacgtctaacaactaacgtaacgaaggccggacgtagggttccggggtttggggttcgggttccgggggaccgggggaacctaacgtacgttcggtacccgttcgtaacgggtccacggcccgaacggtccgtaccccggtccccgttacgggtccttaccgttccgttcccggttcccccg

SEQ ID NO: 344123 - DNA, 616 bp, Homo sapiens
  misc_feature: GZ8MTXP01E15ZO.10.28.C06.1.454.CMB.2.raw
  modified_base (321)..(321): a, c, t, g, unknown or other
  misc_feature (321)..(321): n is a, c, g, or t
  modified_base (434)..(434): a, c, t, g, unknown or other
  misc_feature (434)..(434): n is a, c, g, or t
  modified_base (554)..(554): a, c, t, g, unknown or other
  misc_feature (554)..(554): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggaggtcggggggagcgtttggtacgaggtcccggtgggggggtccctggagactcctcctgtgtagcgtctggattcacattcagtagtatagcatgaactgggtccnccaggctccgagggagggctggagtggttcatatatgatagaaatagtggaaaaccataatactatgcagtactctgtggaggggcccgaattccaacccatccctaccgaanacgaacaaatcggacccaagggtaacttcaacttggtaataggtaggaaatcgtaaacagtctaggacgacggaacccgaagaaacccgacggttacctaccgttacttacgtttacccngggtgacccggaagtacccgggaacccccgttaaaaaagttccgggggttaacttaaacccg

SEQ ID NO: 344124 - DNA, 721 bp, Homo sapiens
  misc_feature: GZ8MTXP01ANAZ7.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaggtgtccggtgtgaggtgcagctgggtgggaggtcggggggagtcgttggtacgaggccggtggggggtccctgagtactctcctgtgtagcgtctggattcactattcagtagttatagcatgaacgtcgggtcccgccgaggcctaccggagggggagggctgggagttgggtttacattatattgaatagaaatagtaggaaaacctataatactatgacagtctcgtggtagggacggggtcctattccacctattcctaccaaggacaacaagtcggacccgtaagggtaaactttcgaaccgttaggtaacgttaggtaagggaaaacttagaaacgtacggttaccgtaaggaacgggaaccggaacccggggaaacgttaaacccggtaacccgggttcccttaccgtttaaccgtttaacgtttaaccccggttgggttaaccgggaaccgggtaaaccgggtaaaccccgggtaaacccccccgggttaaaaaagggttccgggggtttaaacccgtttaaaacccggg

SEQ ID NO: 344125 - DNA, 676 bp, Homo sapiens
  misc_feature: GZ8MTXP01DXEFP.10.28.C06.1.454.CMB.2.raw
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagcgtgggtgggagggtcggggggagtcgttggtacaggccggtggggggtccctgagtactctctgtgagcgtctggattcacattcagtagttatagcatgaacgtgggtccnccgaggccgtcgaggggagggctggaggttggtttanattatatagatagaaatgtagaaacataatactangacagtactcgtaggtggaggggtccgtattaccaccgtacttacccgtacccgaaagaacgtaacgtaaacgtccggaaccgtaacgggttaaactttaccgttaagtttagttaagttaggtaaaggtaaattacgggtaaaactacggtagtacggaacggaacggggaaccgaaaggttaccgaaccgggttccttacggttaccttagtttaccgttaggttcggaacgggtaacggaaccgggtaaccccgttaaaaaggttccgggttaacgtttaaaccg

SEQ ID NO: 344126 - DNA, 588 bp, Homo sapiens
  misc_feature: GZ8MTXP01ESNVX.10.28.C06.1.454.CMB.2.raw
  modified_base (323)..(323): a, c, t, g, unknown or other
  misc_feature (323)..(323): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgcttgggttttccttgttgcttattttagaaggtgtccggtgtgaggtgcagctgggtgggaggtcggggggagcgttggtacaggccgtggggggtccctgagactctctgtgtagcgtctggattcactattcagtagttatagcatgaactgggtccncaggctcgagggagggctggagtggttcatatatagatagaataagagaacatatactatgcagactcgtgtggaggggcctattcacctatctaccgagacgtaacaaagtcgaccgtaagggtaactttacgacgttagtagtggtaaggaaaattgaaactaggtctaggaaggacgaccggaacggacgacggtaccttcgttaccttattaaccgtggtcgacggacggaccgtaaaccccggttaaaagttaaccgggg

SEQ ID NO: 344127 - DNA, 767 bp, Homo sapiens
  misc_feature: GZ8MTXP01AV20Z.10.28.C06.1.454.CMB.2.raw
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactcggacccaccagttacattggtaataatgaatatgtctcctggtaccaacacgtacccaggacaaacgcccccaaatgatgtatttangatgtcagtaactcgaccctgtagggtttcngtactcgtctttcttcgcctacagtctggacacgaccgcctcctgaccccatctcgcggctaccgagcgtggaggacgngctagtatttactactgctacgcctacaaactaacgtaaccggaaggccgggtacggtaacggggttccgggggtttacgggggttccgggggtttaccccgggggggggggaccggggggaaacccctaaccgggtacccggttaccgggtacccccggttaccggttaaccggggttacccgaacccggggtacccccgtaacggggtccccgttcccccggggtccccccccgtttacggggttaccccttaccctttccccggtttacccccgggtttccccccccgttaccccgtttccccttaccccgttaaaccccgttacctttaaccggttccgggacccgttacggggaacccggggttccggggtaacccggg

SEQ ID NO: 344128 - DNA, 756 bp, Homo sapiens
  misc_feature: GZ8MTXP01CQWMP.10.28.C06.1.454.CMB.2.raw
  modified_base (695)..(695): a, c, t, g, unknown or other
  misc_feature (695)..(695): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggttttccttgttgctatttagaggtgtccggtgtgaggtgcagcgtgggtgggaggtcggggggaggtcgttggtacgaggccgtgggggtccctgagactctcctgtgtagcgtctggattcactattcagttagttatagcagtgaacgtgggtcccgccgaggccgtaccggagggggaaggggcgtggtaggttgggttacattaattattagaagtaagaaagtaaagtacggaacctaattaacttaaacttagtacgtacgaagtaccttcgtggttacgggaacgggggtcccgttaactttacccgaaaccctacgtttaccgtacccgaaggaacgaactaaacgtaccggacccggttaaaagggttaactttacccgaaacgtttagttaaaggttagggtaaaggttaaaaagtacgtaaaccgttaggtaccgttagggaacggtaaccgggacccggggaagggaacccgtaccgggtcctttacccgtttagttaccgttttaaccgggngttaacgggacggtaaccgggaaccgggtaaacccccgggttaaaaggttttaacccgggg

SEQ ID NO: 344129 - DNA, 623 bp, Homo sapiens
  misc_feature: GZ8MTXP01DEMML.10.28.C06.1.454.CMB.2.raw
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (554)..(554): a, c, t, g, unknown or other
  misc_feature (554)..(554): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttgggctgtgcttgggttttccttgttgctatttagaaggtgtccggtgtgaggtgcagctgggtgggaggtcggggggaggtcgttggtacaggccgtggggggtccctgagtactctcctgtgtagcgtctggattcactattcagtagttatagcatgaacgtggggtccgccgaggctaccggaagggggaggggtcgtggaggttggtttacatatagttagataagaatagagaaacctataatactangcagctctggngacgggcattcacatctacgaagtaagaaatcgacctaaggtaacttacgacgttagtaacgtaggttaaggaaattcggaaactacggtcgtaggaacggacggacccgggaacggtaccggacggtcccttacgttaaccgttnttaaccgttgggttacgaaggtaacgaaccggtaaccccgtaaaagttacgggtaacttaacgttaacg

SEQ ID NO: 344130 - DNA, 578 bp, Homo sapiens
  misc_feature: GZ8MTXP01DB880.10.28.C06.1.454.CMB.2.raw
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaaataangaatatgtctctgtaccaanagaccaggcaaagaccccaaaatgatgatttangatgtcaagtaatcgaccctacgtagggggtttctgtatcgtcttctttcgcctcaagtctcggacaaacgcgcctccctagacctatctgcgggctacgagtactgaggtacgaggctagtattattactgcagcgtacaacaactaacgaacgacgcgaggtcgggttggggtgggttcggggcggggaccgaacgacgttacggtaccgttcgtacggtcgacgccgacggtaacgtccgtccccgtccggtccttctccgttccgttaacccc

SEQ ID NO: 344131 - DNA, 591 bp, Homo sapiens
  misc_feature: GZ8MTXP01AVIUF.10.28.C06.1.454.CMB.2.raw
  modified_base (372)..(372): a, c, t, g, unknown or other
  misc_feature (372)..(372): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatagaagtcagtaaacgcggcctcgagggggtttctagtcgcttctctcgcctcaagtctggacaacncggcctccctgacatctctcgggctccgagctagacgacgaggctgaatatactgcagctacatagtagtaagcgtggtgccctttctttccgtaaggttttccgggcggtaacgggacccgagggtacttacggaacccgttccttaaacggttcccacggaacccgaacgggtcccgtcccggtccccccgttaccgggttccaacccgtttccccg

SEQ ID NO: 344132 - DNA, 599 bp, Homo sapiens
  misc_feature: GZ8MTXP01EHY3X.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggagggtcggggggagcgttggtacaggccgtggggggtccctgagactctcctgtgtagcgtctggattcactattcagtagttatagcatgaacgtgggtccgcgaggctaccgaggggaggggctggagttggtttcattatagttgaataagaaatagtagaaaccataatactatgcagactgtagtggagggccgtattcaccatacctccaagacgacaatcgaccaggtaattcgattagttataggtaggaaatgaaactgtcgtagaggagccggaaggacgtaacggttcttacgttacttaacgtttacgttaggttcggacggtaacgaaccggtaccccggttaaaaaggtttaaccggggttaactttaaaccgg

SEQ ID NO: 344133 - DNA, 613 bp, Homo sapiens
  misc_feature: GZ8MTXP01BP2B0.10.28.C06.1.454.CMB.2.raw
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (457)..(457): a, c, t, g, unknown or other
  misc_feature (457)..(457): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctcgtgtctgggtctcctggacagtccatcaccatctcctgcactcggacccacagttacattggtaaataatgaatatgtctctggtaccaacagacccaggacaaacgccccaaatgatgatttangatgtcagtaatccgacctgtaggggtttcngtactcgtctttcttcgccctcaagtcgtcggaaccaacgccggccctacccgtgaccctatccgtcgtcgggccttaccagtacgtagggacggacggacggtcttagtaatttacttacgngacacgtcgtacaactaacaacgaacgcgggctagggtcgggttggggttggtaccggggcgggggaccaacgtacgcggtaacccgttcgtacggtcacggttccccgacggtccgtccgccccgtcggtaccttccgtcgttcccggttccccg

SEQ ID NO: 344134 - DNA, 773 bp, Homo sapiens
  misc_feature: GZ8MTXP01CJ28H.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttatttagaggtgtccggtgtgaggtgcagctggggtgggaggtcgggggggaggtcgttgggtacgaggccggttcggggggtccctggacgtactctccgtgtgtacgcgtctggattcatattcagttagttatagctagtaggaacgtcggggtccccgccgagggtccgtaccgggaaggggggaacgggggtcgttagggggtagggtttcggggtttacaagtttagttagtttacggaaagttaaaggtaaacgttaggtaacggtaaaaacctattaactaactagtcgacaagtacttcgtaggtaggggtacggggtaccctagttccaaccctattacccgaccgaaggaacgaacaagtcggacctaaaggttaacttccgaaagtttgaaagttaggtaaaggtaaactacggtaaacctggtttaaccgagggaaaccgaccgggaaaccgaacggaaaaccggtcccggttccgttttaaccttacgtttaaaccgtttcggttacgggtaacggacccggttaaagggaaccccccggtaaaacccgggttaaaaaggtttccggggttaaacctttaaacccg

SEQ ID NO: 344135 - DNA, 581 bp, Homo sapiens
  misc_feature: GZ8MTXP01B33H3.10.28.C06.1.454.CMB.2.raw
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattggtaaataatgaatatgtctcctggtaaccaacagacccaggacaaacgcccccaaatgatgatttangatgtcagtaatccgaccctgtaggggtttcngatcgtcttcttcncctacaagtctggaacaacgcgcctcctgacctatctcgtggctcagactggaggacgaggctagtattatactgacacgctacaactaactacgaacgcggacgtaggtcggggttgggtcgggtccggggaccggggtaccaacgtcgttacggacccgttgacgtcacggcccgaggtccctcccgtaaccccgtcggtccttaccgtccttccgttaaccccc

SEQ ID NO: 344136 - DNA, 552 bp, Homo sapiens
  misc_feature: GZ8MTXP01BE3O7.10.28.C06.1.454.CMB.2.raw
  modified_base (309)..(309): a, c, t, g, unknown or other
  misc_feature (309)..(309): n is a, c, g, or t
  modified_base (510)..(510): a, c, t, g, unknown or other
  misc_feature (510)..(510): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggagcgttggtacagccgtggggggtccctgagactctcctgtgtagcgtctggattcacattcagtagttatagcatgaactgggtccncaggctccgaggggagggctggagttggtttcatatattgatagaaatgtaggaaacataatactaatgcagactctggtggacggggcctattcaccatcctaccagacgacaatcgaccaaggtacttcacgttgtatggtaggaaatgaaacctgtacctgagcgccggaaggaccgacggctacttcttagttccgnggtcgcgaagaccgaccccgttaaaagtcgggttaactaacg

SEQ ID NO: 344137 - DNA, 749 bp, Homo sapiens
  misc_feature: GZ8MTXP01DTA4Z.10.28.C06.1.454.CMB.2.raw
  modified_base (313)..(313): a, c, t, g, unknown or other
  misc_feature (313)..(313): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactcggacccactagttacattaggtaaataatgaatatgtctccgtggtaccaaacacgacccaggacaaacgacccccaaatgatgtatttangtatgtactaagtaaactccgacccttagttagggggtttctgtacttcgtctttccgtttcgccccttacgtaagtcctacggaacccaaaccgtcccggcccttaccccgtacggtaacccctacgttccgtacggttcggggtacccttaccgaacgtacgtacgggaacgggaacggtaacgggtacgttaggttaaacgtttaactttacgtcggactaacggtaccgttaacaaactaaacgtaacgaacgggccggtacgtacggggttcgggggtttggggtaccggggttaccgggggaccgggggtaaccctaacggtaccgttcgggtacccgttcggtacggttaccgaccggttcccgttaacggtcccgttacccggtcccccgttacggtccttacccgtttccgttcccgtttccccccg

SEQ ID NO: 344138 - DNA, 722 bp, Homo sapiens
  misc_feature: GZ8MTXP01C0LAX.10.28.C06.1.454.CMB.2.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
tcagcatagtagtgcacgaccggtgctcgatttagagctcacgtattggggtttgggggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattaggaatatgaatntgtctctggtaccaanacgaccaggacaaacgccccaaatgatgtatttangtatgacaagtaactccgacctggttagggttctgtactcgtctttctttccgcctacgtaagtccgtacggaacccaaacccgccggtccccttaccccgtacgaacccctagtcccgttcggcggggtacctaccgaaggtaccgtagggaacgggacggacggtccgttaggttaacgtttaacgtttacacggacgtaacgtccgtaacctaacgtaacgtaaaccggaacggaccgggtaccgagggggtttccgggggttacgggggttcggggttaccgggggaccccggggggaactaacccggtacggttcggtaaccccggttcggtacggtaccgaccggcccgaacgggtcccgtacccggtcccccgtgggtacccttaccgttcccgttcccgttccccccgg

SEQ ID NO: 344139 - DNA, 621 bp, Homo sapiens
  misc_feature: GZ8MTXP01D35DJ.10.28.C06.1.454.CMB.2.raw
  modified_base (306)..(307): a, c, t, g, unknown or other
  misc_feature (306)..(307): n is a, c, g, or t
  modified_base (445)..(445): a, c, t, g, unknown or other
  misc_feature (445)..(445): n is a, c, g, or t
  modified_base (499)..(499): a, c, t, g, unknown or other
  misc_feature (499)..(499): n is a, c, g, or t
tcagcatagtagtgcacgaccggtgctcgattttagagctcacgtattggggtttgggggggggtctcaggaggcggccctctcgggacgtctccaccatggcctgggctctgctattcctcaccctcctcactcagggcacagggtcctgggcccagtctgccctgactcagcctgcctcgtgtctgggtctctggacagtccatcacatctcctgcacgtcgacccactagttacattaggtaataatgaatatgtctctggtaccaacacgaccaggacaaacgccccaaatgatgtatttannatgtcaagtaactccgaaccttgtaagggggtttcagtactcgtctttctttcgaccctacgtaagttcctacggaaccaaaccgccggtccctacccgtcgaaccctacgttcgtcgtacgggcctaccgagtacgngaacggacgaggtctagtacttacgtactgacacgctacaactaacacgagcgngaggtcgggttggggtcggtcgggccgggggaccaacgtcgcggaccgttcgacggtcgaaccgttccggaacgcccgtcccgtccccgtacggtccttaccgttccgttcccgttcccccg

SEQ ID NO: 344140 - DNA, 621 bp, Homo sapiens
  misc_feature: GZ8MTXP01AWHLG.10.28.C06.1.454.CMB.2.raw
  modified_base (329)..(329): a, c, t, g, unknown or other
  misc_feature (329)..(329): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatgggagttggggctgtgcttgggttttccttgttgcttattttagaaggtgtccggtgtgaggtgcagctgggtgggagggtcggggggaggtcgttgggtaccgaggtcccggtgggggggtccctggagacttctcctgtgtagcgtctggattcacattcagtagttatagcatgaacgtggggtcccnccgaggcgtaccgagggggaaggggctgggaggtggtttacatatattgatagaaatagagaaaaccataatactatgacagtactctggtggacgggggccaattcccaaccattaccacccgaaggaacgaacctaaagtcgaccgtaagggtaactttcgaaacgttgtaagttaggtaagggaaaattggaaactaggtcctaggagacggaaccgaagaaccgacggcttactccttaattcttggcgacgaagacgaccccggttaaaagtccgggttaactaacg

SEQ ID NO: 344141 - DNA, 810 bp, Homo sapiens
  misc_feature: GZ8MTXP01BZMO2.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgcttgggttttccttgttgctattttagaaggtgtccggtgtgaggtgcagcgtgggtgggagggtcggggggaggtcgttggtacacggtccggtgggggggtcccctggacgtactcctccgtggtggtacgcgtcgtggattcactattcgagttagttatagcatgacgtgggtcccgccgaggctaccggaggggaaggggcgtggaggttggtttcatatattagataagaaataagagaaccataatactatgacagacttcgtggtacgggacgggggtacctacgtttacccaaccctacttacccgtaacccgaaggtaaacgaaaccgtaaaacgtccgggtaaccccgggaaaggggttaaaccttttaccgtaaaccgtttaggttaaagttaacggggttaaacggggtaaaaaatttacggtaaaaccgttaacggttcggttaaacggggtaaacgggtaaacccggaccggggtaaaaccggggacccgtaaacccgggggttcccgtttacccgtttaccgttttaaacgttttaaccccggttagggttaaccggggtaaaccccgggaagggttaaaacccccggggttaaaccccccggttaaaaaaaggggttttaaccccggggg

SEQ ID NO: 344142 - DNA, 593 bp, Homo sapiens
  misc_feature: GZ8MTXP01A58CJ.10.28.C06.1.454.CMB.2.raw
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcagctgggtgggaggtcggggggagtcgttggtacaggccgtggggggtccctgagactctcctgtgtagcgtctggattcactattcagtagttatagcatgacgtcgggtcccgcgaggctaccggaggggagggctggagtggtttacagtatatagataagaaatagtagaaacctataatactaatgacagactcgtaggtcggaagggacctattccacctatccgtaccaagaacgaacaagtcgacgtaaggaacttacgaagttgtaagttagtaaggaaataggaaacagtcgagacgacggccgtaagggactacggctacctnttactttcgnggtcgacggaacgaccggtaccccgaaaagtccgggttaacttaaccg

SEQ ID NO: 344143 - DNA, 732 bp, Homo sapiens
  misc_feature: GZ8MTXP01B62KR.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctggttttccttgttgctatttagaggtgtccggtgtgaggtgcagcgtgggtgggagggtcggggggaggtcgttggtacgacggccggtcggggggtccctggacgtacctccgtccgtggtcggtaggtcgtcgtagggtacttacactattacgtaaggttagttatacgctagtagaacgtcggggtcccgaccgaggtccgtaccggagggggaacggggtcgtagggtacggttgggttactagttaatagttagaagttaagaaaagttaaggtaacggtaacctattaattacctagtacgacgtaagtacgttacgtgggtacgggacgggggtaccttaagttcccgaaacctacttccgacccgaaggaacgaactaagtccgaccgtaagggttaactttcaacgttagtaagtagggtaagtaaaacgtacgaaacgtacgtaccgtaggaacgggaacggccgggaaacggaccgtaaccggtcttacttaccgttagttaaccgtgtcggaccggtacgttacccggtaaacccgttaaaggttaacccggg

SEQ ID NO: 344144 - DNA, 628 bp, Homo sapiens
  misc_feature: GZ8MTXP01AQUSP.10.28.C06.1.454.CMB.2.raw
  modified_base (313)..(313): a, c, t, g, unknown or other
  misc_feature (313)..(313): n is a, c, g, or t
  modified_base (441)..(441): a, c, t, g, unknown or other
  misc_feature (441)..(441): n is a, c, g, or t
  modified_base (577)..(577): a, c, t, g, unknown or other
  misc_feature (577)..(577): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggagcttggtacagccgtggggggtccctgagactctcctgtgtagcgtctggattcactattcagtagttatagcatgaacgtcggggtcccnccgaggccgtaccgagggggaaggggctgggtaggttgggtttcagttatatgatagaaactagtagaaacataatactatgacagtactcgtggtaggacgggggccctattcccaaccattacccnccaagacgaacctaatcgacctaaaggaacttcgaacgttagtaacgttaggtacggtaaattacgaaaccgtagttcgaggaacgcggaacccggaagaaaccgaccgggttacgttccttacttagtttaccgnggtcggacggaacgaacccggtaacccggttaaagttcgggttaactaacg

SEQ ID NO: 344145 - DNA, 734 bp, Homo sapiens
  misc_feature: GZ8MTXP01CUOTT.10.28.C06.1.454.CMB.2.raw
  modified_base (688)..(688): a, c, t, g, unknown or other
  misc_feature (688)..(688): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgtcttgggttttccttgttgctattttagaggtgtccggtgtgaggtgcagcgtgggtgggagggtcggggggagtcgttggtacaggccgtgggggtccctgagactctctggtgtagcgtctggattcactattacagttagttatagcagtgaaccgtggggtccccgaccgtaggccgtaccggagggggaacgggggtcgtagggtagtttggggtttctagttaacgttagttagaagttaaggtaaaagttaaagggttaacgggtaacctaattaacgttaaacttagtacgacgtaacgtaacccttgttagggtacgggaacggggggtacccttaactttacccgaaccgtaactttcccgtacccgaagaacgtaactaaagtcccgaccggggtaaaggttaacttacctagttagtagttaggtaaggtaaaatcggtaaactaggtacgtaggaaacgtacggaccgaaagggccgtaaaccggtctttaccttcgttacgtttaaccgnggtaacgaacccgaggaccccgtaaacccggttaaaggttaaccgg

SEQ ID NO: 344146 - DNA, 636 bp, Homo sapiens
  misc_feature: GZ8MTXP01CJQJY.10.28.C06.1.454.CMB.2.raw
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
  modified_base (407)..(407): a, c, t, g, unknown or other
  misc_feature (407)..(407): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactcggacccacagttacattggtaaataatgaatatcgtctccgtgtaaccaanacgacccaggacaaacgacccccaaatgatgtatttangatgtcaagttaactccgacccgtggtaggggtttctgtactcgtctttcttccgccctacgaagttcacggtaaccaaaccgccggtccctcccngaccctatctcgtcgggtctccgaagacgtaggacggtacgaggtctagtattactacgtgacacgtctacaactacgtaacgaaggcggcgaggggttccggggttggggtcgggttcgggggacccgggggtaccaacggtacgttacggtacccgttacggtaacggcgaacgcccgaacggtccgcccgtccccgtggtccttccgttccttccggttaaccccc

SEQ ID NO: 344147 - DNA, 719 bp, Homo sapiens
  misc_feature: GZ8MTXP01D93MA.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttgggctgtgcttgggttttccttgttgctatttagaaggtgtccggtgtgaggtgcagcgtgggtggagggtcggggggaggtcgttggtacaggccggtggggggtccctggacgtacttcctccgtggtgtagtcgtcgtggtattcactattctagttagttatagcaatgaacgtcggggtcccgcgacggcctaccggaagggggtaacgggggcgtagggtagggttgggtttaccaagttaattagtttaccgaagttaaaggaaaagtaggtaacggtaaaaacctaattaactaaaccttaaagtcgactaaggtaccgttcgtagggtagggacggggtcctaagttaccacctaacttcctaccaagaacgaacaagtcgaacgaaggtaacttactaacgttagttaagtaggtaaaggtaaattacgaaacgtaagtctacgggaagaaccggaaccgaaaggaaaccggccggttaccttacgttacttacgtttacgttcggttcggaccggtaacggaaaccggaccccgttaaaaagttccggggttaacttaaaccgg

SEQ ID NO: 344148 - DNA, 670 bp, Homo sapiens
  misc_feature: GZ8MTXP01A5QTM.10.28.C06.1.454.CMB.2.raw
  modified_base (211)..(211): a, c, t, g, unknown or other
  misc_feature (211)..(211): n is a, c, g, or t
tcagcatagtagtgcacgaccggtgctcgatttagagctcacgtattggggtttgggggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcacntctcctgccactcggacccactagttacattaggtaataatgaatattgtctccgtaggtaaccaacacgtaaccacggaccaaaccgacccccaaatgaatgtatttagagtatgtacaagtaactccggtacctggttagggtttcagtactcgtctttcttcgacctacgtaagtctacggaaccaaccgtccggtaccctcccgtacgacctatccgtcgtcgggaccttcgaagacgtagggacggtacggtaggtcttagtaacttagttacgtcgacacgtctaactaacgtaacgtaacgacggcggacgtacggggtcgggttaggggtccgggtacgggggccggggtaacccaagtcggttccgtaccggttacgtacggtaccgaccgacccggttcggccccgtcggcccccgttcggaccttcccgttccgttccccgtcccccg

SEQ ID NO: 344149 - DNA, 697 bp, Homo sapiens
  misc_feature: GZ8MTXP01CMSRR.10.28.C06.1.454.CMB.2.raw
  modified_base (201)..(201): a, c, t, g, unknown or other
  misc_feature (201)..(201): n is a, c, g, or t
  modified_base (271)..(271): a, c, t, g, unknown or other
  misc_feature (271)..(271): n is a, c, g, or t
  modified_base (521)..(521): a, c, t, g, unknown or other
  misc_feature (521)..(521): n is a, c, g, or t
  modified_base (609)..(609): a, c, t, g, unknown or other
  misc_feature (609)..(609): n is a, c, g, or t
  modified_base (676)..(676): a, c, t, g, unknown or other
  misc_feature (676)..(676): n is a, c, g, or t
tcagcatagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacngtccatcaccatctctgcactcggacccacagttacattagtaaatatgaatatgtctctaggtaccaanacgaccagacaacgaccccaaatgatgtatttagtgattgtactaagtaacgtccgtacccgttcgggttaacggggtttctagtacgttcgtccgttttcttccccggtccttaccgtaagtccgtacggaaacccttaaccgcccggtccccttacccgtacgaacccctgttcccgttcggtaccgggtaccctaccgaacggtaccgtagggaacggacggtacggtcttagtaacttacttacgngtacacgttaccgtacaactaactaaccgaagggcccggtggaacgggtttcgggtcggggttacggtccgggggaccggggtaaccnccgtaacggttcgacccggttcgtacggtccacgttcccgacggtccctaccggccccgttcgtccnccttccgttcccgtaaccccc

SEQ ID NO: 344150 - DNA, 637 bp, Homo sapiens
  misc_feature: GZ8MTXP01CUGMP.10.28.C06.1.454.CMB.2.raw
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (504)..(504): a, c, t, g, unknown or other
  misc_feature (504)..(504): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgtactggacccacagttacattggaaataatgaatatgtctctggtaccaacagtacccaggacaaacgcccccaaatgatgtatttangatgtacagtaactcgaccctgtagggttttcngtatcgtctttctttcgcccccttacaagttcgtacggaccaaaacccgtaccggtccctacccgtacgaccctactcccgtcgtcggggcctaccgagtacgtaggaggacggaggacttagtattatacgtgcagtcctacgaactataaccgaaggccggacgngggtcggggttggggtcgggtccgggggaccgggggacctacggtaacgtcggttaccgtcggacgtaccgacgacccggacgttcccgtccgccccgtcggtcctacgttcccgttccggttccccgtcccc

SEQ ID NO: 344151 - DNA, 698 bp, Homo sapiens
  misc_feature: GZ8MTXP01CFUXE.10.28.C06.1.454.CMB.2.raw
  modified_base (441)..(441): a, c, t, g, unknown or other
  misc_feature (441)..(441): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgtcttattttagaaggttgtccggtgtgaggtgcagcgtgggtgggagggtcggggggagtcgttggtacgaggcccggttggggggtccctaggacgtacctctccgtggtgtagtcgtcgtggacttcactattcagttagttatagcagtgaaccgtcggggtcccgacgacggccgtaccgggagggggaacggggtcgttagggtaggtttacgggtttacaagttatagtttagaataaagaaagtagtacgaaaacctattaanactagtgacagtacgtcgtgggtacgggacggggacctattaccaactactccgtaaccgaagacgaaacacgtacggacctaaggtaaacttcgtaacgttgtaagttaggaagaaagtcgaaacgtacgtcgtaaggacggaacgtaaccggaaagaaccgtaccggttcttacgttacccttagtttcgacggtaaggaccgaaacggtacccgtaaaaccccgggttaaagttcccgggttaactttaaaccg

SEQ ID NO: 344152 - DNA, 606 bp, Homo sapiens
  misc_feature: GZ8MTXP01A8R75.10.28.C06.1.454.CMB.2.raw
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (511)..(511): a, c, t, g, unknown or other
  misc_feature (511)..(511): n is a, c, g, or t
  modified_base (557)..(557): a, c, t, g, unknown or other
  misc_feature (557)..(557): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggagggtcgggggggaggtcgttgggtaccgaggcccggtgggggggtccctggagacctctcctgtgtagcgtctggattcactattcagtattatagcatgacgtgggtccncaggcncgagggagggcnggagtggttacatatattacgatagaaatgagaaaccatntactatgacagtactctgggtaggacgggggtccaattccgaacctacttacacccgaagaacgaccaaagtccgaaccgtagggaaacttcaacgttgtagtaggtaggtaaattcggaaataggttcngaacgacggcggtaggaaccgtaccggcttccctaattagttccgngttggaccggaagaaccgaccccggaaagttaacggggttccctaacgg

SEQ ID NO: 344153 - DNA, 599 bp, Homo sapiens
  misc_feature: GZ8MTXP01EUA2H.10.28.C06.1.454.CMB.2.raw
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccaccagttacattggtaaataatgaatatgtctcctggtaccaacagtaccccaggcaaacgcccccaaactgatgatttangatgtcagtaactcgtaccctcgagggggttttcctgatcgtctttctttccgcctacaagtctggacaacnccggcctccctgaccatctcgtgggcctcagactggaggacgaggctagtattattactgacncgctacactaataacgaagccggngtacggtcgggttggggtcggttccggggcgggggaccaacgaacgttggacccgttccgtaggtaccacgttcccgaacggtccgtccggtcccccgttcgggtccacctcccgtttccgtaacccccc

SEQ ID NO: 344154 - DNA, 629 bp, Homo sapiens
  misc_feature: GZ8MTXP01BPJW3.10.28.C06.1.454.CMB.2.raw
  modified_base (283)..(283): a, c, t, g, unknown or other
  misc_feature (283)..(283): n is a, c, g, or t
tcagcatagtagtgcacgaccggtgctcgatttagagctcacgtattggggtttggggagctctcagagaggtgccttagccctggattccaaggcatttccacctggtgatcagcactgaacacagaggactcaccatggagttggggctgtgctgggttttcctgttgctattttagaggtgtcggtgtgaggtgcagctgggtgggaggtcggggggagcttgggtacaggccgtggggggtccctggagacctctcctgtgtagcgtctggattcactnttcagtagttatagcagtgaacgtcgggtccgccgagggcctacggagggggagggctagggtggttggttcagttatattgatagaaatgacggaaacataatactatcgcaagtcctgtggtcgggacgggggtacctaattccaaacccttataccgtacgaagaacgacacgtcgaccgtaagtacttacgtagtagtagtaggtaagtaaacgtacgaacgtgtcgtaggacggacggaaccggaacggaccgtcggttccgttacgttacgttacgttcgaggtaacggaacggtaacggaacccggtaacccggttaaaggttccggttaaccgtaacg

SEQ ID NO: 344155 - DNA, 737 bp, Homo sapiens
  misc_feature: GZ8MTXP01CWP6Q.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgcttgggttttccttgttgcttattttagaggtgtccggtgtgaggtgcagcgtgggtgggagggtcggggggaggtcgttggtacgaggccggtcggggggtccctggagactctccgtgtgtacgcgtctggattcactattcaagttagttaatagcagtaggaacgtcgggggtcccgccgaacggccgtaccggaaggggggaacgggggcgttagggggtaggtttaggggtttacaagtttaacgttattaggaattaaaggtaaaacttaaagggtacggaacctaaattaaacttaaccttagtgactacgacttcgtggtagggacggggacctacttaccacctacttcgtacccgaaggacaaacgtaaactccggaacccgtaagggttaaactttaccgaacgtttaggttaacgttagggtaaggtaaaacgttggaaacgtacggttaccgaaggtaacggaacggccgggaacggaaccgtaccgggtctttacgttacttagttaaccggttgaacggtaccgaacggaaccggtaacccgttaaaaggtttccggg

SEQ ID NO: 344156 - DNA, 580 bp, Homo sapiens
  misc_feature: GZ8MTXP01CKV9Y.10.28.C06.1.454.CMB.2.raw
  modified_base (501)..(501): a, c, t, g, unknown or other
  misc_feature (501)..(501): n is a, c, g, or t
  modified_base (527)..(527): a, c, t, g, unknown or other
  misc_feature (527)..(527): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggaggtcggggggaggtcgttgggtacaggccggtggggggtccctggagtactctcctgtgtagcgtctggattcactattcagtagttatagcatgaactgggtcccgcaggctccgaggggaaggggctgggagttgggtttacatatatgatagaaatagtaggaaaacctataatactatgacagactctgtggaggggccattccaccatcctacgagaacgaacaatcgaccaaggtaattcaacgttgtaagttagtaggaaattgaaacagttcagacgnggaacccgaaggaccacggcttcgtnttacttacgttgtgcgtaagaccggacccgttaaaagtcgggttaacgttaac

SEQ ID NO: 344157 - DNA, 690 bp, Homo sapiens
  misc_feature: GZ8MTXP01AQDXG.10.28.C06.1.454.CMB.2.raw
  modified_base (309)..(309): a, c, t, g, unknown or other
  misc_feature (309)..(309): n is a, c, g, or t
  modified_base (608)..(608): a, c, t, g, unknown or other
  misc_feature (608)..(608): n is a, c, g, or t
tcagcatagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagcctgcctccgtgtctgggtctccgtggacagtccatcaccatctcctgcacgtcgacccactagttactattggtaataatgaatatgtctcgtgtaccaactacgaccaggacaaccgacccaatgatgtatttgntatgtataagtactcgtacctgtagggtttctgacttcgtctttcgttccgacctcgtaagtcgtagaaccctaacccgtcccggtcccttaccccgtagtacccctacgttccgtccgggtcggtaccctacgtaacggtaccggtacggacgggtaacgggaaccggttagtaggttaactttaaccgttacgtcgaaccgtacgtaccgttaccgaaactacgtaacggtaaccgggcggtacgggtacgggggttccgggggttggggtccggggtaccggggacccgggggacncggtacggttacggtaccgttccgtacggtacgcgcccgacggcctacccgcccgtcggtccttcggtccttcccgtccccg

SEQ ID NO: 344158 - DNA, 728 bp, Homo sapiens
  misc_feature: GZ8MTXP01AMV4E.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgtctatttagaggtgtcggtgtgaggtgcagcgtgggtgggagggtcggggggagtcgttggtacgaggtccggtggggggtccctggacgtacctctccgtggtgtaggtcgtcgtggtacttcactattctagttagttatagctagtacggaacgtcggggtccccgccgacggccgtaccggaaggggggagggggcgttggggtacggtttgggtttacaagttagttaattaggtaataaagtaaagtaggtacgaaaacctataactactagtgacacgtactcgtaggtgggacggggtacctagttaccacctataccctaccgaaggtaacgaactaagtccgaacccgtaagggtaactttacccgaaggttgttaagttaggtaaaggtaaaacgttaggtaaacctaggttaccgtaggaaccggacgggaacccggaacgggaacccgtcggttacctttcttacgtttacgtttaccgttggtaaccgggacgaacggtaacccggaaaaccccggttaaagtaacggggttaacctaaaccg

SEQ ID NO: 344159 - DNA, 778 bp, Homo sapiens
  misc_feature: GZ8MTXP01AN2SG.10.28.C06.1.454.CMB.2.raw
  modified_base (337)..(337): a, c, t, g, unknown or other
  misc_feature (337)..(337): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgtcgttgggttttccttgttgcttattttagaaggtgtccggtgtgaggtgcgagcgtgggtgggagggtcggggggagtcgttggtacacggtcccggttggggggtccctggacgtacttcctccgtggtcggtagcgtcgtaggacttacacgtattacgaagttagttanagctagtcgtaaccgtcggggtccccgacgtacgggtaccgtaccggaagggggaacgggggtccgttagggtaccggtttggtttacaatttacgttagttagtaagtaaacgaaagttaaggtaacgtaacctattaaacttaacctagtacgactaagtaccttacgttagggtacgggaacggggaccttacttacccgaaccgttactcccgtaaccgaaggactaacaagttccgaccggtaaggtaacttacgtaacgttgtaagtggtaaagtaaacgtcgtaaacgtacggttaccgaaggtaacggaaccggaccgggtaaacggaaccgtaacccggttcctttacgttaaccgtttaccgtttaacggcggtttaacgaaccggtaaccggttaacccgtaaaccccgggttaaaagttttaacccggg

SEQ ID NO: 344160 - DNA, 655 bp, Homo sapiens
  misc_feature: GZ8MTXP01AECPE.10.28.C06.1.454.CMB.2.raw
  modified_base (324)..(324): a, c, t, g, unknown or other
  misc_feature (324)..(324): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttatttagaaggtgtccggtgtgaggtgcagctgggtgggaggtcggggggaggtcgttggtacaggtccggtggggggtccctggacgacttctcctgtgtagtcgtctggattcactattcagtattatagctagtgaacgtcgggtccncgagcgtacggaggggagggcgtgggtagttgggtttacattatagttagaagtaagaaatagtacggtaaaacctataacttacgtaatgactacgtacttcggttagggagggtacgggggtacctattacccacctacttccgaacaagaacgaaacgtaatcggaccgtaaggaactttcgaacttggttaagaggttaaggaaagtagtaaacgtgtaccgtaggaacggacgaacggaacgaccgtacggcttacgtactttacgttcgttaggtcggaacgaaccggtaaccggaaacccgttaagttaacggaacgttaaacc

SEQ ID NO: 344161 - DNA, 599 bp, Homo sapiens
  misc_feature: GZ8MTXP01B2L79.10.28.C06.1.454.CMB.2.raw
  modified_base (324)..(324): a, c, t, g, unknown or other
  misc_feature (324)..(324): n is a, c, g, or t
  modified_base (442)..(442): a, c, t, g, unknown or other
  misc_feature (442)..(442): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttgggctgtgcttgggtttccttgttgtctattttagaaggtgtccggtgtgaggtgcagctgggtggaggtcggggggagtcgtttaggtacaggtccgtgggggggtccctggacgacttctccttaggtgtagcgtctggattcactattcagtagttatagcatgaactggggtcccncgaggctaccggaggggagggctggagttgggttacagtatattagacttaagaatacgtaggaaaacccattaatactatgcacgtactcgtaggtggaggggcctaattcaacctntacctaccgaagacgacaaagtcgaccgtaaggtaacttcgaaaagttgttaagtagtaacgggaaattaggaactaggttcaggaagacgaacggaacgacagctctacttnttcttggnacggaagaccgaacccgttaaagtcggttaacaacg

SEQ ID NO: 344162 - DNA, 931 bp, Homo sapiens
  misc_feature: GZ8MTXP01AOAA2.10.28.C06.1.454.CMB.2.raw
tcagcatagtagtgcacgaccggtgctcgatttagagctcacgtattgggtttgggggagctctcagagaggtgccttagccctggattccaaggcatttccacctggtgatcagcactgaacacagaggactcaccatggagttgggctgtgtcgttgggttttccttgttgtcttatttagaaggtgtccggtgtgaggtgcagcgtgggtgggagggtcggggggaggtcgttggtacgacggtccggttcggggggtccctggacgtactctccgtggtgtagtcgttcgtggtattcactattcgtagtagttatagctatacgacgtcgggtcccgcgacggccgtaccggagggggaacggggtcgtagggtacggttagggtttactaagttagttattaggtaaattaaaggtaaaacgttaagggtaaccggtaaaaaacccttaagttaacgttaaaccgttaagttacggaccgtaacgggttaacccgtttcgggttaacggggtaacgggggtaccgggggtaaccccttaacggtttaacccccaaaaccgttactttaacccccggacccgtaaaagggaaaccgtaaaccgtaaaaccggttacgggaaacccccgtttaaaggggtaaaccgttttaacccgtaacggtttaaggtttaaccgtttaaagggggtaaagggttaaaaacccgtaaggttaaaaccccggttaaggtttaccgggtaaaggggtaaaacccggggtcggggaaacccccgggttaaacgggaacccgggttaccggggttaccctttaaacggttaaccgttaccggtttaaacgttcgggggttaacccgaccgggtaaaacgggtaaccccccggtaaaaccgggttaaaaacgggttccggggttaaacccctttaaacgg

SEQ ID NO: 344163 - DNA, 639 bp, Homo sapiens
  misc_feature: GZ8MTXP01BQW96.10.28.C06.1.454.CMB.2.raw
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (429)..(429): a, c, t, g, unknown or other
  misc_feature (429)..(429): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccacagttacattgtaataatgaatatgtctcctaggtaccaanagtacccaggacaaacgcccccaaatgatgatttatgatgtacagtaactcgacccttgtagggtttcngatcgtctttcttgcctactaagtctaggaccaaccaccggtcctaccctacgaccccattcgtcgtaggccctaaccgagaacgtggaacgggacgaggtcttagtatttactacgtgctagctanactactaacgaacggcggacgtaggtcgggttaggggttcgggttaccggggggacgggggaccctacgtaccgtacgacccgtccgtacggtaccgaccgtccgaaccggtcctaccggtccccgttcggcctacccttccgttaccgttccccttacccgttcccttaccaacttactaactcgtcgttacggtaacgcgggtaaccg

SEQ ID NO: 344164 - DNA, 630 bp, Homo sapiens
  misc_feature: GZ8MTXP01BNZZ2.10.28.C06.1.454.CMB.2.raw
  modified_base (307)..(307): a, c, t, g, unknown or other
  misc_feature (307)..(307): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagacccaggcaaagcgacccaaactgatgaatttangatgtacaagtaactcgaacccctgtagggggtttctgatcgtcttcctttcgctccaagtctagggaccaactacggcccttccctagaccagtctctcggctcagactgaggacgaggtctgattacttaatgactacgggcttcaactactaacaaacggcggaccgtaagggtccgggtttgggggttacggtttcgggggcggggggtaacccgaacgaaaccggttcgacccggttaccgtaacgggttccgacggaccccgaaacggtccgtccggtccccccgttaccgggttaccctaaccgttccttccccgg

SEQ ID NO: 344165 - DNA, 718 bp, Homo sapiens
  misc_feature: GZ8MTXP01BVAQG.10.28.C06.1.454.CMB.2.raw
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (506)..(506): a, c, t, g, unknown or other
  misc_feature (506)..(506): n is a, c, g, or t
tcagcatagtagtgcacgaccggtgctcgatttagagctcacgtattggggtttggggggaagaggaagactgacggtcctgccacaggtggtgctgggcacggtgggcactcgacacaacatttgcgctcaactgtcttgactcaccatggagttgggctgtgtcgttgggttttccttgttgtcttagttttaggaaggtgtccggtgtgaggtgcagtcgtgggtgggngggtcgggggagtgttggacncggtccggtcgggggtccctgacgtctctcgtgtgngtcgtgtagntcactnttacgtagtagttatagctagtacggacgtcgggtccgaccgaggtccggtacgggaagggggtacgggtcggttaggtaggtttaggttatagttaacgttattaggtaagtaaagtaagtaaacggtacgaacctagtaactaacgtagtcgtacgacgtactggttaggacgggacgggtcctaattccgtaaccgtntaccacgaaggactaaactacgtaccggaaccgtaagttacctacgtagttagtagttaggtaaagtaaaccgttgaacgtaggttcgaaggaaccggtacggaccggaacggttaccgtaccgttacgttccctttaagttaccgtttaaggccgtaaccggaaccggttaaaccggaaccccgttaaaaccgggttaaagtttaacccgg

SEQ ID NO: 344166 - DNA, 284 bp, Homo sapiens
  misc_feature: GZ8MTXP02JTEBJ.10.28.C06.1.454.CMB.2.raw
  modified_base (284)..(284): a, c, t, g, unknown or other
  misc_feature (284)..(284): n is a, c, g, or t
tcagcatagtagtgcacgaccggtgctcgatttagagctcacgtattggttgggtgtggtggtctccactccgccttgacgggctgctatctgcctccctgaccatctctgggctccagactgaggacgaggctgattattactgcagctcacatacaagcggcagcggttgggtgttcggcggggaccacactgaccgtcctaggtcagcccaaggctgcccctcggtcactctgttcccacctcctccactactatgctgagcggctggcaaggcgcatagn

SEQ ID NO: 344167 - DNA, 532 bp, Homo sapiens
  misc_feature: GZ8MTXP02JJQWG.10.28.C06.1.454.CMB.2.raw
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
  modified_base (436)..(436): a, c, t, g, unknown or other
  misc_feature (436)..(436): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttangatgtcagtaatcgaccctcaggggtttctgatcgcttctttcgcctccaagtctggcaacncggcctccctgacccatctctgggctccagactgaggacgagctgattatactgcagctcacatacaagcgnagtcggttggtggttcgggcgggggaccacgacgtgacccgtctacgggtcaacgcccaaggcctcgccccctcggtccacgtcgtcgttcccccg

SEQ ID NO: 344168 - DNA, 521 bp, Homo sapiens
  misc_feature: GZ8MTXP02HIMQ9.10.28.C06.1.454.CMB.2.raw
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (444)..(444): a, c, t, g, unknown or other
  misc_feature (444)..(444): n is a, c, g, or t
tcagcatagtagtgcacgaccggtgctcgatttagagctcacgtattgggtttgggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttatgatgtcagtaatcgaccctnaggggtttctgatcgcttctttgcctcaagtctggcaacncggcctcctgaccatctctgggctccagactgaggacgaggctgattatactgcagctcacatacaagcgcaggcggttgggngttcgggcgggggacacgacgtcgaccgtcgtacggtcacgcccaggcgtcgcccccgtcgtcactctcgttccccg

SEQ ID NO: 344169 - DNA, 528 bp, Homo sapiens
  misc_feature: GZ8MTXP02HQ8PM.10.28.C06.1.454.CMB.2.raw
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (424)..(424): a, c, t, g, unknown or other
  misc_feature (424)..(424): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaaagcccccaaaactgatgatttatgatgtcagtaatcgaccctnaggggtttctgatcgcttctttgcctcaagtctggcaacncggcctcctgaccatctctgggctcagctgaggacgagctgattatactgcagctcanatacaagcgcagcggttgggtgttcgggcgggggtaccacgacgtgaccgtcgtacggtcgacgcccgaaggccgtcgccccgtcggtccacgtctcgttcccc

SEQ ID NO: 344170 - DNA, 549 bp, Homo sapiens
  misc_feature: GZ8MTXP02JLOFV.10.28.C06.1.454.CMB.2.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctctggtaccaacagtacccaggcaaacgcccccaaatgatgatttangatgtcagtaatcgacctcgtaggggtttcngatcgtctttcttcgcctcaagtctggacaacncggcctccngaccatctctgactccagactgaggacgagctagtattattactgcagctacacatacgaagcggacgaggtcgggttgggtggttcggggcgggggtaccacgacgtcggacccgtcgtacggtcgacgccgaacggcgtccggccccgtcggtccacgttcctcgttcccccg

SEQ ID NO: 344171 - DNA, 540 bp, Homo sapiens
  misc_feature: GZ8MTXP02HQNGT.10.28.C06.1.454.CMB.2.raw
  modified_base (324)..(324): a, c, t, g, unknown or other
  misc_feature (324)..(324): n is a, c, g, or t
  modified_base (366)..(366): a, c, t, g, unknown or other
  misc_feature (366)..(366): n is a, c, g, or t
  modified_base (472)..(472): a, c, t, g, unknown or other
  misc_feature (472)..(472): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagtaccccaggcaaagcccccaaactgatgatttatgatgtcagtaatcgacctnaggggtttctgatcgcttctttgcctccaagtctggccaacncggcctccctgacccatctctgggctccagactgaggacgaggctgattattactgcagctcacatacaagcgacaggcggttgggtggttcgggcgggggacccncgacgtcggaccgtccgtacggtccacgacccaaggccgtcgccccctcggcaccgtctcgttccccc

SEQ ID NO: 344172 - DNA, 553 bp, Homo sapiens
  misc_feature: GZ8MTXP02G1VE7.10.28.C06.1.454.CMB.2.raw
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctctggtaccaacagtacccaggacaaacgccccaaactgatgtattatgatgtcaagtaatcgaccctcgaggggtttctgacttcgtcttcttgcctcaagtctggacaacgacgtcctcctgaccccatctcgtcgggctccagcgtggaggacgagctagtattattactgcagctacacatacaagcgcgaggtcgggttgggtggtcggggcgggggacacgacgtgaccgtcgacggtcgacgccgaagcgtccgccccgtcggtccaccgttcgtccgttccccgaccctcctacctaacgtactacgtcgcgtcgacgcggtcg

SEQ ID NO: 344173 - DNA, 540 bp, Homo sapiens
  misc_feature: GZ8MTXP02HWGMX.10.28.C06.1.454.CMB.2.raw
  modified_base (319)..(319): a, c, t, g, unknown or other
  misc_feature (319)..(319): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctccctccgcgtccaggtctcctggacagtcagtcaccatctcctgcactggaaaccagcagtgacttttgtgctttaataactatgtctctggtaccagcaccaccaggcaaagccccaaatccttgttttgagtcagtaagcgcctnaggatccctgatcggtctctgcctccaagtctcggcaacaccggcctccctgaccgtctctgggctccaggctgaggagtgaggcgtgtattactaactcgcagcgcatattcacgacccaaccgaggtggttggcggcgggacgtaaggtacgaccgtccgtcggtcgacgaccgaacgcgcgccccgtccgtcgctctcgtcccgtccctcctcctacc

SEQ ID NO: 344174 - DNA, 542 bp, Homo sapiens
  misc_feature: GZ8MTXP02HVNTR.10.28.C06.1.454.CMB.2.raw
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (472)..(472): a, c, t, g, unknown or other
  misc_feature (472)..(472): n is a, c, g, or t
tcagcatagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaatatgtctcctggtaccaacagtaccaggcaaacgccccaaactgatgatttatgatgtcagtaatcgacctcgaggggtttcngatcgctttcttcgcctcagtctggcacncggcctcctgaccatctcgtcggctcagactgacggacgtaggctgattattactagcagctacacatacaagcgcgagcgggttgggtggttcgggacgggggaccncgacgtcggaaccgtcgtaacggtcgacgcccgaaggccgtcgccccgtcggctacctctccgttacccc
